United States Patent
Bazirgan et al.

(10) Patent No.: US 10,640,574 B2
(45) Date of Patent: May 5, 2020

(54) HUMANIZED ANTIBODIES WITH ULTRALONG COMPLEMENTARY DETERMINING REGIONS

(71) Applicant: Taurus Biosciences, LLC, San Diego, CA (US)

(72) Inventors: Omar Bazirgan, San Diego, CA (US); Miguel De Los Rios, Del Mar, CA (US)

(73) Assignee: Taurus Biosciences, LLC, San Diego, CA (US)

( * ) Notice: Subject to any disclaimer, the term of this patent is extended or adjusted under 35 U.S.C. 154(b) by 12 days.

(21) Appl. No.: 14/905,765

(22) PCT Filed: Jul. 18, 2014

(86) PCT No.: PCT/US2014/047315
§ 371 (c)(1),
(2) Date: Jan. 15, 2016

(87) PCT Pub. No.: WO2015/010100
PCT Pub. Date: Jan. 22, 2015

(65) Prior Publication Data
US 2016/0159928 A1 Jun. 9, 2016

Related U.S. Application Data

(60) Provisional application No. 61/856,010, filed on Jul. 18, 2013.

(51) Int. Cl.
| | |
|---|---|
| *C07K 16/28* | (2006.01) |
| *C07K 14/575* | (2006.01) |
| *A61K 39/00* | (2006.01) |
| *A61K 38/16* | (2006.01) |
| *C07K 16/00* | (2006.01) |
| *C07K 14/605* | (2006.01) |
| *C07K 14/61* | (2006.01) |
| *C07K 14/635* | (2006.01) |
| *C07K 14/81* | (2006.01) |
| *C07K 7/08* | (2006.01) |
| *C07K 14/64* | (2006.01) |
| *C07K 16/46* | (2006.01) |
| *C07K 16/10* | (2006.01) |
| *C07K 14/435* | (2006.01) |
| *C07K 14/52* | (2006.01) |
| *C07K 14/54* | (2006.01) |
| *C07K 14/655* | (2006.01) |

(52) U.S. Cl.
CPC ...... *C07K 16/464* (2013.01); *C07K 14/43504* (2013.01); *C07K 14/43522* (2013.01); *C07K 14/522* (2013.01); *C07K 14/54* (2013.01); *C07K 14/5421* (2013.01); *C07K 14/655* (2013.01); *C07K 16/00* (2013.01); *C07K 16/005* (2013.01); *C07K 16/1081* (2013.01); *C07K 2317/20* (2013.01); *C07K 2317/24* (2013.01); *C07K 2317/565* (2013.01); *C07K 2317/75* (2013.01); *C07K 2317/76* (2013.01); *C07K 2317/92* (2013.01); *C07K 2318/10* (2013.01); *C07K 2319/00* (2013.01)

(58) Field of Classification Search
None
See application file for complete search history.

(56) References Cited

U.S. PATENT DOCUMENTS

| | | | |
|---|---|---|---|
| 6,740,747 B2 | 5/2004 | Kaushik et al. | |
| 7,196,185 B2 | 3/2007 | Kaushik et al. | |
| 7,575,893 B2 | 8/2009 | Simmons | |
| 7,592,010 B2 | 9/2009 | Rosen et al. | |
| 9,221,902 B2 | 12/2015 | Smider et al. | |
| 9,403,904 B2 | 8/2016 | Smider et al. | |
| 9,644,021 B2 | 5/2017 | Wang et al. | |
| 10,101,333 B2 | 10/2018 | Smider et al. | |
| 2003/0088074 A1 | 5/2003 | Hamers et al. | |
| 2003/0170646 A1 | 9/2003 | Kaushik et al. | |
| 2003/0215880 A1 | 11/2003 | Burton | |
| 2005/0261480 A1* | 11/2005 | Foote | C07K 16/18 530/387.1 |
| 2006/0275254 A1 | 12/2006 | Kim et al. | |
| 2007/0071764 A1* | 3/2007 | Sullivan | A61K 47/48215 424/178.1 |
| 2009/0148455 A1 | 6/2009 | Fischer et al. | |
| 2009/0304580 A1 | 12/2009 | Goldenberg et al. | |
| 2010/0311119 A1 | 12/2010 | Hermans et al. | |
| 2011/0039761 A1 | 2/2011 | Eckert et al. | |
| 2011/0172125 A1 | 7/2011 | Ladner | |
| 2011/0293513 A1 | 12/2011 | Govindan et al. | |
| 2011/0318339 A1 | 12/2011 | Smider et al. | |
| 2012/0058906 A1 | 3/2012 | Smider et al. | |
| 2012/0316071 A1 | 12/2012 | Smider et al. | |

(Continued)

FOREIGN PATENT DOCUMENTS

| | | |
|---|---|---|
| JP | 2005-522197 | 7/2005 |
| WO | WO-1993/20210 | 10/1993 |

(Continued)

OTHER PUBLICATIONS

Almagro & Fransson, 2008, Frontiers in Bioscience; 13:1619-33.*
Choi et al., 2011, Molecular BioSystems, 2011, 7:3327-334; specifically p. 3327.*
Almagro & Fransson, Frontiers in Bioscience 2008; 13:1619-33.*
De Genst et al., Developmental and Comparative Immunology, 2006, 30:187-98.*
Ward et al., Nature, 1989, 341:544-546.*
Barthelemy et al., Journal of Biological Chemistry, 2008, 283:3639-3654.*
Choi et al., 2011, Molecular BioSystems, 2011, 7:3327-334.*
Griffiths et al. (The EMBO Journal, 1993, 12:725-734).*

(Continued)

*Primary Examiner* — Julie Wu
(74) *Attorney, Agent, or Firm* — Morrison & Foerster LLP

(57) ABSTRACT

The present disclosure provides humanized antibodies, including antibodies comprising an ultralong CDR3 and uses thereof.

29 Claims, 113 Drawing Sheets

Specification includes a Sequence Listing.

(56) References Cited

U.S. PATENT DOCUMENTS

| | | |
|---|---|---|
| 2014/0050720 A1 | 2/2014 | Smider et al. |
| 2014/0086871 A1 | 3/2014 | Smider et al. |
| 2014/0227267 A1* | 8/2014 | Wang ................ C07K 16/2869 424/134.1 |
| 2015/0011431 A1 | 1/2015 | Smider et al. |
| 2015/0376264 A1 | 12/2015 | Wang et al. |
| 2016/0069894 A1 | 3/2016 | Smider et al. |
| 2016/0159928 A1 | 6/2016 | Bazirgan et al. |
| 2016/0168231 A1 | 6/2016 | De Los Rios et al. |
| 2016/0194627 A1 | 7/2016 | Smider et al. |
| 2016/0237156 A1 | 8/2016 | Wang et al. |
| 2018/0222999 A1 | 8/2018 | Smider et al. |

FOREIGN PATENT DOCUMENTS

| | | |
|---|---|---|
| WO | WO-1994/018221 | 8/1994 |
| WO | WO-2002/022809 | 3/2002 |
| WO | WO-2003/030821 | 4/2003 |
| WO | WO 2003/085086 | 10/2003 |
| WO | WO-2005/056759 | 6/2005 |
| WO | WO-2010/028791 | 3/2010 |
| WO | WO-2010/054007 | 5/2010 |
| WO | WO-2010/054010 | 5/2010 |
| WO | WO-2011/044542 | 4/2011 |
| WO | WO-2011/056997 | 5/2011 |
| WO | WO-2012/170977 | 12/2012 |
| WO | WO-2013/106485 | 7/2013 |
| WO | WO-2013/106489 | 7/2013 |
| WO | WO-2014/110368 | 7/2014 |
| WO | WO-2015/010100 | 1/2015 |
| WO | WO-2015/017146 | 2/2015 |

OTHER PUBLICATIONS

Klimka et al., British Journal of Cancer, 2000, 83:252-260.*
Beiboer et al. (Journal of Molecular Biology, 2000, 296:833-849).*
Ottensmeier et al. (Blood, 2000, 96:2550-2556).*
Saini et al., "Exceptionally long CDR3H region with multiple cysteine residues in functional bovine IgM antibodies," European Journal of Immunology, (1999) 29(8): 2420-2426.
Smider, "Cow Antibodies: A New Structural Class of Antibody Using Ultralong CDR3s," World ADC, Oct. 16, 2013. Retrieved from http://adc-summit.com/uploads/files/2463_ADC_/Vaughn_Smider.pdf.
Stanfield et al., "Conservation and diversity in the ultralong third heavy-chain complementarity-determining region of bovine antibodies," Science Immunology (2016) 1:aaf7962.
Wang et al., "Reshaping Antibody Diversity," Cell (2013) 153(6):1379-1393.
Zhang et al., "An Antibody CDR3-Erythropoietin Fusion Protein," ACS Chem Biol (2013) 8(10):2117-2121.
Zhang et al., "Functional Antibody CDR3 Fusion Proteins with Enhanced Pharmacological Properties," Angew Chem Int Ed Engl (2013) 52(32):8295-8298.
Zhang et al., "Rational Design of humanized dual-agonist antibodies," Journal of the American Chemical Society (2015) 137(1):38-41.
U.S Appl. No. 15/660,852, filed Jul. 26, 2017, by Smider et al.
U.S. Appl. No. 14/946,445, filed Nov. 19, 2015, Smider et al.
U.S. Appl. No. 15/140,175, filed Apr. 27, 2016, Smider et al.
Baker, P.J., "The pain of "chronic Lyme disease": moving the discourse in a different direction," The FASEB Journal, 26(1):11-12 (2012).
Brumeanu et al., "Efficient loading of identical viral peptide onto class II molecules by antigenized immunoglobulin and influenza virus," J. Exp. Med 178(5):1795-1799 (1993).
Casset et al., "A peptide mimetic of an anti-CD4 monoclonal antibody by rational design," BBRC 307(1):198-205 (2003).
Chen et al., "Selection and analysis of an optimized anti-VEGF antibody: crystal structure of an affinity-matured Fab in complex with antigen," J. Mol. Bio. 293(4): 865-881 (1999).
Haakenson et al., "Diversity in the cow Ultralong CDR H3 Antibody repertoire," Frontiers in Immunology (2018) 9:1262.
Hosseini et al., "Duplicated copies of the bovine JH locus contribute to the Ig repertoire," Int. Immunol. (2004) 16(6):843-852.
Hust et al., "Single chain Fab (scFab) fragment," BMC Biotechnology (2007) 7:14.
Inoue et al., "Affinity transfer to a human protein by CDR3 grafting of camelid VHH," Protein Science. 20(12):1971-1981 (2011).
Lefranc et al., "IMGT, the international ImMunoGeneTics information system." Nucleic Acids Res. Jan. 2009;37(Database issue):D1006-12.
Muyldermans et al., "Distinct Antibody Species: Structural Differences Creating Therapeutic Opportunities," Curr Opin Immunol. Jun. 2016; 40: 7-13.
NCBI, GenBank accession No. DM113215.1 (Jun. 18, 2009).
Nuttal et al., "Selection and affinity maturation of IgNAR variable domains targeting Plasmodium falciparum AMA1," Proteins: Structure, Function, and Bioinformatics. 55(1):187-197 (2004).
Pistillo et al., "Molecular Characterization and Applications of Recombinant SCFV Antibodies to CD152 Co-Stimulatory Molecule," Tissue Antigens 55(3):229-238.
Qin et al., "Fusion protein of CDR mimetic peptide with Fc inhibit TNF-alpha induced cytotoxicity," Molecular Immunology 43(6):660-666.
Qiu et al.,"Small antibody mimetics comprising two complementarity determining regions and a framework region for tumor targeting," Nature Biotechnology 25(8):921-929 (2007).
Rader et al., "The rabbit antibody repertoire as a novel source for the generation of therapeutic human antibodies," Journal of Biological Chemistry. 275:13668-13676 (2000).
Ramsland et al., "Incorporation of long CDR3s into V domains: implications for the structural evolution of the antibody combining site," Experimental and Clinical Immunogenetics. 18(4):176-198 (2001).
Roche et al., "Invited review: Body condition score and its association with dairy cow productivity, health, and welfare," J. Dairy Sci., 92(12):5769-5801 (2009).
Saini et al., "Bovine IgM antibodies with exceptionally long complementarity-determining region 3 of the heavy chain share unique structural properties conferring restricted VH + Vlambda pairings," International Immunology, 15(7):845-853 (2003).
Simmons et al., "Shark IgNAR antibody mimotopes target a murine immunoglobulin through extended CDR3 loop structures," Proteins: Structure, Function, and Bioinformatics. 71(1): 119-130 (2008).
Sok et al., "Rapid elicitation of broadly neutralizing antibodies to HIV by immunization in cows," Nature. Aug. 3, 2017; 548(7665): 108-111.
Streltsov et al., "Crystal Structure of the Amyloid-p3 Fragment Provides a Model for Oligomer Formation in Alzheimer's Disease," Journal of Neuroscience. 31(4) 1419-1426 (2011).
Streltsov et al., "Supplemental Material Crystal Structure of the Amyloid-p3 Fragment Provides a Model for Oligomer Formation in Alzheimer's Disease," (2011) Journal of Neuroscience. 31(4) 1419-1426 (2011).
Wells "Additivity of Mutational Effects in Proteins," Biochemistry 29:8509-8517 (1990).
Wold et al., "Antibody Therapeutics in Oncology," Immunotherapy (Los Angel). Mar. 2016 ; 2(1):pii:108.
Wynne et al., "Oxyntomodulin increases energy expenditure in addition to decreasing energy intake in overweight and obese humans: a randomised controlled trial," International Journal of Obesity 30(12):1729-1736 (2006).
Yang et al., "The three complementarity-determining region-like loops in the second extracellular domain of human Fc alpha/mu receptor contribute to its binding of IgA and IgM," Immunobiology 218:(5):798-809 (2013).
Zhao et al., "The bovine antibody repertoire," Developmental and Comparative Immunology. 30:175-186 (2006).

* cited by examiner

Figure 1

```
BLV1H12   CTSVHQ  EHKKYQ  SCPDGYRERSDCSMRPACGTSDCCRVSVPGMCLTHLPVSYSYTYMYEW  HVDVWGQGLLVTVSS  (SEQ ID NO: 360)
BLV5B8    CTTVHQ  ETRKT   CSDGYIAVDSCGRGGSDGCVDCCVNDCNSCYYGMRNCRRQPAIHSYEF  HVDAWGRGLLVTVSS  (SEQ ID NO: 361)
BLV5D3    CSSVTQ  RTHVSR  SCPDGCSDGDCVDGCCCSAVRCYTPGVRDLSCTSYSITYTYEW       NVDAWGKGLLVTVSS  (SEQ ID NO: 362)
BLV8C11   CTTVHQ  RTTRET  CCSDAYRYDSGCGSGCDCCGADCYVFGACTFGLDSSYSYIYIYQW     YVDAWGQGLLVTVSS  (SEQ ID NO: 363)
BF4E9     CTTVHQ  IF      CPRGYSYGYSCGYGYGCSGYDCYGYGGYSGYGGYSSYSYSYSYSYEY   YGDAWGQGLLVTVSS  (SEQ ID NO: 364)
BF1H1     CTTVHP          SPEGYSYGYGCGYGSYGYSYDCYGYGGYGGYGGYGGYSSYS                         (SEQ ID NO: 365)
F18       CTTVHQ  IR      CPEGYGYGCGYGSYGYSYDCYGYGSYDCYGYGYGGYGGYGYSSYS                     (SEQ ID NO: 366)
```

Figure 2A

| | | | | |
|---|---|---|---|---|
| $V_H$ Germ | CTTVHQ | SCPDGYSYGYCGGYGCSMDCYGYGGYGGYGYGYGYGYSYSYTYEY | YVDAWGQGTLVTVSS | (SEQ ID NO: 185) |
| $D_{H}2$ Germ | ETKYQ | | | (SEQ ID NO: 274) |
| $J_{H}1$ Germ | | | | (SEQ ID NO: 275) |

Published sequences:

| | | | | Length | |
|---|---|---|---|---|---|
| BLV1H12 | CTTVHQ EIKYQ | SCPDGYKERSDCSNRAACQTSDCCKVSVFGMCLILFVSVSYTNTEW | HVDVW | 61 | (SEQ ID NO: 276) |
| BLV5B8 | CTTVHQ ETRKT | SCSDGTIAVDSCGRGQSDGCVNDCNSCYYGWRKCRRQFAIHSYEF | HVDAW | 56 | (SEQ ID NO: 277) |
| BLV5D3 | CSSVTQ KTHVSK | SCPDGCSDGDSCVDGSCCSAYRCKTFGVRDLSCTSSISIYTYEW | NVDAW | 57 | (SEQ ID NO: 278) |
| BLV8C11 | CTTVHQ KTTRKT | CCSAYRVDSCGDGSGSCDCCQYEGACTFGLDSNSYIYIYQW | YVDAW | 58 | (SEQ ID NO: 279) |
| BF4E9 | CTTVHQ IF | CPDGSNSVGCGYGVGSSGYDCGVGYGGGYGSSISYSYSYEY | EGDAW | 58 | (SEQ ID NO: 280) |

| B-11 | CSTVHQ KTRTTQGRT | CPDGYTIKDCCPRCRGGCDGYDCCWGDACRSSGLCWGHNPLVTETYTYEF | YIDAW | 66 | (SEQ ID NO: 281) |
| B-L2 | CAYVHQ THLRD | CPGGYTEDRSCVNTYCGRAIDCCGRGGVGKFAIVSYRCAAHIQHYNW | HADAW | 59 | (SEQ ID NO: 282) |

Longest CDR H3s:

| UL-1 | CSTVHQ KTRTTQHFY | LSIMVTILKDDCPRCRGGCDGYDCCWGDACRSSGLCWGANPLVTETYTYEF | YIDAW | 67 | (SEQ ID NO: 283) |
| UL-2 | CSTVHQ KTRTTQGRN | LSIMVTILKDFCPRCRGGCDGYDCCWGDACRSSGLCWGHNPLVTETYTYEF | YIDAW | 67 | (SEQ ID NO: 284) |
| UL-3 | CSTVHQ KTRTTQGN | TCPDGYTLKDDCPRCRGGCDGNDCWGDACRSGGLCWGANPLVTETYTYEF | YIDAW | 66* | (SEQ ID NO: 285) |
| UL-4 | CSTVHQ KTRTTQSN | TCPDGYTFKDDCPRCRGGCDGYDCCWGDACRSSGLCWGANPLVTETYTYEF | YIDAW | 65 | (SEQ ID NO: 286) |
| UL-5 | CSTVHQ KTRTTQGN | TCPDGYTLKNDCPRCRGGCDGYDCCWGDACRSSGLCWGANPLVTETYTYEF | YIDAW | 66 | (SEQ ID NO: 287) |
| UL-6 | CSTVHQ KTRTTQGN | TCPDGYTLKNDCPRCRGGCDGYDCCWGDACTSSGLCWGANPLVTETYTYEF | YTDAW | 66 | (SEQ ID NO: 288) |
| UK-7 | CTTVVQ KTRTTQGH | TCPDGYTLKRDCPRCRGGCDGYDCCWGDACRSGACRSGLCWGANPLVTETYTYEF | YIDAW | 66 | (SEQ ID NO: 289) |
| UL-8 | CSTVHQ KFGQHKGI | LVLMVTIIKDDCPRCRGGCDGNDCCWSDACRSSGLCWGANPLVTETYTYEF | YIDAW | 66 | (SEQ ID NO: 290) |
| UL-9 | CSTVHQ KTRTTQSI | LVLMVTILKDDCPRCRGGCDGYDCCWGDACRSSGLCWGHNPLVTETYTYEF | YIDAW | 66 | (SEQ ID NO: 291) |

12 Cysteines:

| UL-10 | CSTVHQ EIRK | CCPAGCQCGRSGCGACCCAGDEFCGINVYGYVTGGYRTCSCIDTYDF | YVDAW | 59 | (SEQ ID NO: 292) |
| UL-11 | CSPVEQ QTRK | CCPASCQCGESCGACCCQGESCGDEFCGINVGKITCCGYPTCSCIDYDF | KVEAW | 59 | (SEQ ID NO: 293) |

10 Cysteines:

| UL-12 | CATVYQ KTKQSK | NCPEGSAWCRSCDGGAGCADYECCRGWSGCSWRGACECSSLSSSYTYEL | HVDAW | 64 | (SEQ ID NO: 294) |
| UL-13 | CSTVHQ TTHQIH | TCPNGWTSGCVGSSRFWCRGMNCCCRTAYCSVDRYVCACFTVTYTYEF | NVDSW | 61 | (SEQ ID NO: 295) |
| UL-14 | CTAVYQ KTHSIR | SCPDGTVSCPSACCDCDCCGSSWCICMERCTSAPFETYYEL | HIDAW | 61 | (SEQ ID NO: 296) |
| UL-15 | CSWHQ KTKH | TCPDGYTVSCDCSSSGEADYGCCSYITTGVFGCGCGCCSYKHNTYEW | NVDAW | 61 | (SEQ ID NO: 297) |
| UL-16 | CTTVHQ KTKH | LCPNGRTCCSCQDCGSGCCTSVQDSRFGCWGGRDTFGSSCTSATYTYEW | GVDAW | 59 | (SEQ ID NO: 298) |
| UL-17 | CATVHQ HTNKK | RCPDGYKFSAGCCCGBGCSGDCCCRSRLRCSWTETTYCSVSPSDTYEF | HVDAW | 60 | (SEQ ID NO: 299) |
| UL-18 | CTTVHQ HTNKK | RCPGYRFSAACCCGECCSGMECCCNTRLRCSWHLICSVSRSTYEF | HVDAW | 60 | (SEQ ID NO: 300) |
| UL-19 | CSTVHQ HDNQM | RCPTGIRHSAGCCCGVCSGNDCCCRSRLRCSWYETYCSLSPTMYEF | YVDAW | 60 | (SEQ ID NO: 301) |
| UL-20 | CSTVHQ HTNQM | RCPAGYRHSAGCCCGVCSGWNCCCRSRLPCSWHTYCSLSPTDMYEF | YVDAW | 60 | (SEQ ID NO: 302) |

Figure 2A

Figure 2B (sequence listing figure - not transcribed in detail)

Figure 2C

Other Representative sequences:

| | | | |
|---|---|---|---|
| UL-58 | QVTVHQ QTHAER | RCPDGYGDSYACKSRYGCSABGCCRWGFGSCRACTGAIYTSPYEW | YVDAW 57 (SEQ ID NO: 340) |
| UL-59 | QAAVHQ ETEGQQ | SCPDGYLETRVCYRMYRCIGWGCCRCSDGSERDKYIMTYSYEF | HVDVW 56 (SEQ ID NO: 341) |
| UL-60 | QGTVYQ HTKTKS | GCPDSISCCYNGRSKSCREMDCSTYGEVRSLSKSCYTENEF | YVDAW 55 (SEQ ID NO: 342) |
| UL-61 | QGTVLQ HTKEIK | TCPDGYSDVFTYCPVTCPGWDCERRMDCGRTRYTVAYSYAL | HVDVW 54 (SEQ ID NO: 343) |
| UL-62 | QSTVLQ ETHQQE | GCPAGYQVVDGCPYGDCCFTSYVGGPLFCPSRTAFRNYQW | YVDAW 53 (SEQ ID NO: 344) |
| UL-63 | QSTVYQ KTEK | RCPDGYTDRRIDECCRRTCKNFDCRREGGIECLCSAYISAYEF | HVDAW 52 (SEQ ID NO: 345) |
| UL-64 | QTTTHQ RTQK | SCPDYASYDCGSFDDEECSSCRSCTRWCAPTAPYIYTYQF | YIDAW 51 (SEQ ID NO: 346) |
| UL-65 | QTTDHQ QTNK | RCPTGYRSGTLCRMIGCGDECNYGRVECTSYVWTHRF | YVDAW 50 (SEQ ID NO: 347) |
| UL-66 | QSTVHQ ETQRI | QCPSGWTYTCNCRMGCCCYRPSQLCGAYVAVTHTYEF | HVDAW 49 (SEQ ID NO: 348) |
| UL-67 | QATVHQ KDK | HCPAGYPSGTLCRMIGCTGDDCNYDRVECTRYDYTMNF | YVDAW 49 (SEQ ID NO: 349) |
| UL-68 | QTAVHQ QTTEKGK | TCFPKSRDMGTKCKDERYYPWEYSDYTYTYEW | HVETW 48 (SEQ ID NO: 350) |
| UL-69 | QSTVHQ KTDV | TCPSGATYRCECGCRGCCGYDPWCSTTYRGTYTDF | HVETW 47 (SEQ ID NO: 351) |
| UL-70 | QGTVHQ ETHHTQR | TCPDACDVTGDNCKVPRANGDWCGRASKIDTYDF | YVDAW 46 (SEQ ID NO: 352) |
| UL-71 | QTTDYQ KTEK | SCPERYYAETGICACGSWRCGYGSTTSLIVSYEW | YVDAW 45 (SEQ ID NO: 353) |
| UL-72 | QGTVHQ KTNQKW | GCPDGYVHMSGSCCRGSICTNGLFRNTYTYEF | NVEAW 45 (SEQ ID NO: 354) |
| UL-73 | QSTVYQ KRT | NCPDGYNYRSGDCRKWNHWLSRQKVSPTTNYEW | YVGSW 44 (SEQ ID NO: 355) |
| UL-74 | QTTVYQ KTTTTK | SCPGFDMGRRCIMSLGDLRDYTYFNKYEW | YVETW 43 (SEQ ID NO: 356) |
| UL-75 | QSTVHQ KTEQ | RCLDYIDDRGAYCYDSVRGLMSWTYKYVYEW | KVCTW 42 (SEQ ID NO: 357) |
| UL-76 | QRNVHQ MTIK | TCPDGSYGWYMPYGYGCNGGVSATTYEF | YVDAW 41 (SEQ ID NO: 358) |
| UL-77 | QETVYQ KTESVE | SCPDGSMDGWKQRLGTNMWIISRTYEF | YVDAW 40 (SEQ ID NO: 359) |

Figure 3

BLV1H12
SVHQETKKYQSCPDGYRERSDCSNRPACGTSDCCRVSVFGNCLTTLPVSYSYTYNYEWHVD
(SEQ ID NO : 22)

BLV5B8
TVHQETRKTCSDGYIAVDSCGRGQSDGCVNDCNSCYYGWRNCRRQPAIHSYEFHVD
(SEQ ID NO : 23)

BLV5D3
SVTQRTHVSRSCPDGCSDGDGCVDGCCCSAYRCYTPGVRDLSCTSYSITYTYEWNVD
(SEQ ID NO : 24)

BLV8C11
TVHQKTTRKTCCSDAYRYDSGCGSGCDCCGADCYVFGACTFGLDSSYSYIYIYQWYVD
(SEQ ID NO : 25)

BF4E9
TVHQIFCPDGYSYGYGCGYGYGCSGYDCYGYGGYGYGGYGGYSSYSYSYSYEYYGD
(SEQ ID NO : 26)

BF1H1
TVHPSPDGYSYGYGCGYGYGCSGYDCYGYGGYGYGGYGGYSSYSYSYS
(SEQ ID NO : 27)

F18
TVHQIRCPDGYGYGYGCGYGSYGYSGYDCYGYGGYGGYGGYGGYSSYS
(SEQ ID NO : 28)

Figure 4

Bovine VH-UL:

```
caggtgcagctgcggagtcgggccccagcctggtgaagccctcacagaccctctcgctc
 Q  V  Q  L  R  E  S  G  P  S  L  V  K  P  S  Q  T  L  S  L
acctgcacggcctctggattctcattgagcgacaaggctgtaggctgggtccgccaggct
 T  C  T  A  S  G  F  S  L  S  D  K  A  V  G  W  V  R  Q  A
ccagggaaggcgctggagtggctcggtggtatagacactggtggaagcacaggctataac
 P  G  K  A  L  E  W  L  G  G  I  D  T  G  G  S  T  G  Y  N
ccaggcctgaaatcccggctcagcatcaccaaggacaactccaagagccaagtctctctg
 P  G  L  K  S  R  L  S  I  T  K  D  N  S  K  S  Q  V  S  L
tcagtgagcagcgtgacaactgaggactcggccacatactactgtactactgtgcaccag  (SEQ ID NO: 367)
 S  V  S  S  V  T  T  E  D  S  A  T  Y  Y  C  T  T  V  H  Q  (SEQ ID NO: 29)

QVQLRESGPSLVKPSQTLSLTCTASGFSLSDKAVGWVRQAPGKALEWLGGIDTGGSTGYN
PGLKSRLSITKDNSKSQVSLSVSSVTTEDSATYYCTTVHQ  (SEQ ID NO: 29)
```

Figure 5A 4-39:
Cagctgcagctgcaggagtcgggcccaggactggtgaagccttcggagaccctgtccctcacctgcactgtctctgg
tggctccatcagcagtagtagttactactgggctggatccgccagcccccagggaaggggctggagtggattggga
gtatctattatagtgggagcacctactacaacccgtccctcaagagtcgagtcaccatatccgtagacacgtccaag
aaccagttctccctgaagctgagctctgtgaccgccgcagacacggctgtgtattactgtgcgagacacacagtgag
ggg
(SEQ ID NO: 368)

QLQLQESGPGLVKPSETLSLTCTVSGGSISSSSYYWGWIRQPPGKGLEWIGSIYYSGSTYYNPSLKSRVTISVDTSK
NQFSLKLSSVTAADTAVYYCAR
(SEQ ID NO: 31)

4-59*03:
Caggtgcagctgcaggagtcgggcccaggactggtgaagccttcggagaccctgtccctcacctgcactgtctctgg
tggctccatcagtagttactactggagctggatccggcagcccccagggaagggactggagtggattgggtatatct
attacagtgggagcaccaactacaaccctccctcaagagtcgagtcaccatatcagtagacacgtccaagaaccaa
ttctccctgaagctgagctctgtgaccgctgcggacacggccgtgtattactgtgcg
(SEQ ID NO: 369)

QVQLQESGPGLVKPSETLSLTCTVSGGSISSYYWSWIRQPPGKGLEWIGYIYYSGSTNYNPSLKSRVTISVDTSKNQ
FSLKLSSVTAADTAVYYCA
(SEQ ID NO: 32)

4-34*09:
Caggtgcagctgcaggagtcgggcccaggactggtgaagccttcacagaccctgtccctcacctgcgctgtctatgg
tgggtccttcagtggttactactggagctggatccgccagcccccagggaagggactggagtggattgggaaatca
atcatagtggaagcaccaactacaaccngtccctcaagagtcgagttaccatatcagtagacacgtctaagaaccag
ttctccctgaagctgagctctgtgactgcggcggacacggccgtgtattactgtgcgaga
(SEQ ID NO: 370)

QVQLQESGPGLVKPSQTLSLTCAVYGGSFSGYYWSWIRQPPGKGLEWIGEINHSGSTNYNPSLKSRVTISVDTSKNQ
FSLKLSSVTAADTAVYYCAR
(SEQ ID NO: 33)

4-34*02:
Caggtgcagctacaacagtggggcgcaggactgttgaagccttcggagaccctgtccctcacctgcgctgtctatgg
tgggtccttcagtggttactactggagctggatccgccagcccccagggaagggctggagtggattgggaaatca
atcatagtggaagcaccaactacaaccgtccctcaagagtcgagtcaccatatcagtagacacgtccaagaaccag
ttctccctgaagctgagctctgtgaccgccgcggacacggctgtgtattactgtgcgagagg
(SEQ ID NO: 371)

QVQLQQWGAGLLKPSETLSLTCAVYGGSFSGYYWSWIRQPPGKGLEWIGEINHSGSTNYNPSLKSRVTISVDTSKNQ
FSLKLSSVTAADTAVYYCAR
(SEQ ID NO: 34)

Figure 5B

```
4-39        QLQLQESGPGLVKPSETLSLTCTVSGGSISSSSYYWGWIRQPPGKGLEWIGSIYYSGSTY  60
4-59*03     QVQLQESGPGLVKPSETLSLTCTVSGGSISS--YYWSWIRQPPGKGLEWIGYIYYSGSTN  58
4-34*02     QVQLQQWGAGLLKPSETLSLTCAVYGGSFSG--YYWSWIRQPPGKGLEWIGEINHSGSTN  58
4-34*09     QVQLQESGPGLVKPSQTLSLTCAVYGGSFSG--YYWSWIRQPPGKGLEWIGEINHSGSTN  58
VH-UL       QVQLPESGPSLVKPSQTLSLTCTASGFSLSD--KAVGWVRQAPGKALEWLGGIDTGGSTG  58
            *:**::  *. .*:***:******:.  * *:*      .*:**.***.***:* *  .***

4-39        YNPSLKSRVTISVDTSKNQFSLKLSSVTAADTAVYYCAR-----  99  (SEQ ID NO: 31)
4-59*03     YNPSLKSRVTISVDTSKNQFSLKLSSVTAADTAVYYCA------  96  (SEQ ID NO: 32)
4-34*02     YNPSLKSRVTISVDTSKNQFSLKLSSVTAADTAVYYCAR-----  97  (SEQ ID NO: 33)
4-34*09     YNPSLKSRVTISVDTSKNQFSLKLSSVTAADTAVYYCAR-----  97  (SEQ ID NO: 34)
VH-UL       YNPGLKSRLSITKDNSKSQVSLSVSSVTTEDSATYYCTTVHQTQ  102 (SEQ ID NO: 29)
            ***.****::*:  *.**.*.**..:*.**;
```

Figure 6

```
BLV1H12 VL:

Caggctgtgctgaatcagccatcatccgtgtccgggtccctgggccagagggtctccatcacctgctctggaagcag
cagcaatgttggaaatggatatgtgagctggtaccaactgatcccaggatcggccccagaaccctcatctatggtg
acaccagtcgagcctcgggggtccccgaccgattctccggctccaggtctgggaacacagccaccctgaccatcagc
tcgctccaggctgaggacgaggcagattatttctgtgcatctgctgaggatagtagcagtaatgctgttttcggcag
cgggaccacactgaccgtcctg
(SEQ ID NO: 372)

QAVLNQPSSVSGSLGQRVSITCSGSSSNVGNGYVSWYQLIPGSAPRTLIYGDTSRASGVPDRFSGSRSGNTATLTIS
SLQAEDEADYFCASAEDSSSNAVFGSGTTLTVL
(SEQ ID NO: 35)
```

Figure 7A

V11-47:
Cagtctgtgctgactcagccaccctcagcgtctgggaccccgggcagagggtcaccatctcttgttctggaagcag
ctccaacatcggaagtaattatgtatactggtaccagcagctcccaggaacggcccccaaactcctcatctatagga
ataatcagcggccctcaggggtccctgaccgattctctggctccaagtctggcacctcagcctcctggccatcagt
gggctccggtccgaggatgaggctgattattactgtgcagcatgggatgacagcctgagtggtcc
(SEQ ID NO: 373)

QSVLTQPPSASGTPGQRVTISCSGSSSNIGSNYVYWYQQLPGTAPKLLIYRNNQRPSGVPDRFSGSESGTSASLAIS
GLRSEDEADYYCAAWDDSLSG
(SEQ ID NO: 36)

V11-40*1:
Cagtctgtgctgacgcagccgccctcagtgtctggggccccagggcagagggtcaccatctcctgcactgggagcag
ctccaacatcggggcaggttatgatgtacactggtaccagcagcttccaggaacagcccccaaactcctcatctatg
gtaacagcaatcggccctcaggggtccctgaccgattctctggctccaagtctggcacctcagcctcctggccatc
actgggctccaggctgaggatgaggctgattattactgccagtcctatgacagcagcctgagtggttc
(SEQ ID NO: 374)

QSVLTQPPSVSGAPGQRVTISCTGSSSNIGAGYDVHWYQQLPGTAPKLLIYGNSNRPSGVPDRFSGSKSGTSASLAI
TGLQAEDEADYYCQSYDSSLSG
(SEQ ID NO: 37)

V11-51 *01:
Cagtctgtgttgacgcagccgccctcagtgtctgcggccccaggacagaaggtcaccatctcctgctctggaagcag
ctccaacattgggaataattatgtatcctggtaccagcagctcccaggaacagcccccaaactcctcatttatgaca
ataataagcgaccctcagggattcctgaccgattctctggctccaagtctggcacgtcagccaccctgggcatcacc
ggactccagactggggacgaggccgattattactgcggaacatgggatagcagcctgagtgctgg
SEQ ID NO: 375)

QSVLTQPPSVSAAPGQKVTISCSGSSSNIGNNYVSWYQQLPGTAPKLLIYDNNKRPSGIPDRFSGSKSGTSATLGIT
GLQTGDEADYYCGTWDSSLSA
SEQ ID NO: 38)

V12-19*02:
Cagtctgccctgactcagcctccctcgtgtccgggtctcctggacagtcagtcaccatctcctgcactggaaccagcagtgacgt
tggtagttataaccgtgtctcctggtaccagcagcccccaggcacagcccccaaactcatgatttatgaggtcagtaatcggccct
caggggtccctgatcgtttctctggctccaagtctggcaacacggcctcctgaccatctctgggctccaggctgaggacgaggct
gattattactgcagctcatatacaagcagcagcacttc
(SEQ ID NO: 376)

QSALTQPPSVSGSPGQSVTISCTGTSSDVGSYNRVSWYQQPPGTAPKLMIYEVSNRPSGVPDRFSGSKSGNTASLTI
SGLQAEDEADYYCSSYTSSSTF
(SEQ ID NO: 39)

Figure 7B

```
V11-47      QSVLTQPPSASGTPGQRVTISCSGSSSNIGSNY-VYWYQQLPGTAPKLLIYRNNQRPSGV 59
V11-51      QSVLTQPPSVSAAPGQKVTISCSGSSSNIGNNY-VSWYQQLPGTAPKLLIYDNNKRPSGI 59
V11-40*1    QSVLTQPPSVSGAPGQRVTISCTGSSSNIGAGYDVHWYQQLPGTAPKLLIYGNSNRPSGV 60
V12-18*02   QSALTQPPSVSGSPGQSVTISCTGTSSDVGSYNRVSWYQQPPGTAPKLMIYEVSNRPSGV 60
V11x (cow)  QAVLTQPSSVSGSLGQRVSITCSGSSSNVGNGY-VSWYQLIPGSAPRTLIYGDTSPASGV 59
            *: **** * *   **  *:*:*:*:**::*    * ***  **:**: :**   .*.**:

V11-47      PDRFSGSKSGTSASLAISGLRSEDEADYYCAAWDDSLSG  98   (SEQ ID NO: 36)
V11-51      PDRFSGSKSGTSATLGITGLQTGDEADYYCGTWDSSLSA  98   (SEQ ID NO: 37)
V11-40*1    PDRFSGSKSGTSASLAITGLQAEDEADYYCQSYDSSLSG  99   (SEQ ID NO: 38)
V12-18*02   PDRFSGSKSGNTASLTISGLQAEDEADYYCSSYTSSSTF  99   (SEQ ID NO: 39)
V11x        PDRFSGSRSGNTATLTISSLQAEDEADYFCASAEDSSSN  98   (SEQ ID NO: 35)
            *******:**.:*:*  *:.*::  ****:*  :  .* ;
```

Figure 8

| Designation | V1 Alternative A | V1 Alternative B |
|---|---|---|
| VH4-34_Q5RQ6E | QVQLREWGAGLLKPSETLSLTCAVYGGSFSGYYWSWIRQPPGKGLEWIGEINHSGSTNYNPSLKSRVTISVDTSKNQFSLKLSSVTAADTAVYY (SEQ ID NO: 734) | QVQLREWGAGLLKPSETLSLTCAVYGGSFSGYYWSWIRQPPGKGLEWIGEINHSGSTNYNPSLKSRVTISVDTSKNQFSLKLSSVTAADTAVYYC (SEQ ID NO: 735) |
| VH4-34_CDR1-G31DY32K_Q5RQ6E | QVQLREWGAGLLKPSETLSLTCAVYGGSFSDKYWSWIRQPPGKGLEWIGEINHSGSTNYNPSLKSRVTISVDTSKNQFSLKLSSVTAADTAVYY (SEQ ID NO: 736) | QVQLREWGAGLLKPSETLSLTCAVYGGSFSDKYWSWIRQPPGKGLEWIGEINHSGSTNYNPSLKSRVTISVDTSKNQFSLKLSSVTAADTAVYYC (SEQ ID NO: 737) |
| VH4-34_CDR2-E50S_Q5RQ6E | QVQLREWGAGLLKPSETLSLTCAVYGGSFSGYYWSWIRQPPGKGLEWIGSINHSGSTNYNPSLKSRVTISVDTSKNQFSLKLSSVTAADTAVYY (SEQ ID NO: 738) | QVQLREWGAGLLKPSETLSLTCAVYGGSFSGYYWSWIRQPPGKGLEWIGSINHSGSTNYNPSLKSRVTISVDTSKNQFSLKLSSVTAADTAVYYC (SEQ ID NO: 739) |
| VH4-34_CDR1-G31DY32K_CDR2-E50S_Q5RQ6E | QVQLREWGAGLLKPSETLSLTCAVYGGSFSDKYWSWIRQPPGKGLEWIGSINHSGSTNYNPSLKSRVTISVDTSKNQFSLKLSSVTAADTAVYY (SEQ ID NO: 740) | QVQLREWGAGLLKPSETLSLTCAVYGGSFSDKYWSWIRQPPGKGLEWIGSINHSGSTNYNPSLKSRVTISVDTSKNQFSLKLSSVTAADTAVYYC (SEQ ID NO: 741) |
| VH4-34_CDR1-Cow_Q5RQ6E | QVQLREWGAGLLKPSETLSLTCTASGFSLSDKAVGWIRQPPGKGLEWIGEINHSGSTNYNPSLKSRVTISVDTSKNQFSLKLSSVTAADTAVYY (SEQ ID NO: 742) | QVQLREWGAGLLKPSETLSLTCTASGFSLSDKAVGWIRQPPGKGLEWIGEINHSGSTNYNPSLKSRVTISVDTSKNQFSLKLSSVTAADTAVYYC (SEQ ID NO: 743) |
| VH4-34_CDR2-Cow_Q5RQ6E | QVQLREWGAGLLKPSETLSLTCAVYGGLGSIDTGGNTGSFSGYYWSWIRQPPGKGLEWYNPSLKSRVTISVDTSKNQFSLKLSSVTAADTAVYY (SEQ ID NO: 744) | QVQLREWGAGLLKPSETLSLTCAVYGGLGSIDTGGNTGSFSGYYWSWIRQPPGKGLEWYNPSLKSRVTISVDTSKNQFSLKLSSVTAADTAVYYC (SEQ ID NO: 745) |
| VH4-34_CDR1-Cow_CDR2-E50S_Q5RQ6E | QVQLREWGAGLLKPSETLSLTCTASGFSLSDKAVGWIRQPPGKGLEWIGSINHSGSTNYNPSLKSRVTISVDTSKNQFSLKLSSVTAADTAVYY (SEQ ID NO: 746) | QVQLREWGAGLLKPSETLSLTCTASGFSLSDKAVGWIRQPPGKGLEWIGSINHSGSTNYNPSLKSRVTISVDTSKNQFSLKLSSVTAADTAVYYC (SEQ ID NO: 747) |
| VH4-34_CDR1-Cow_CDR2-Cow_Q5RQ6E | QVQLREWGAGLLKPSETLSLTCTASGFSLSDKAVGWIRQPPGKGLEWLGSIDTGGNTGYNPSLKSRVTISVDTSKNQFSLKLSSVTAADTAVYY (SEQ ID NO: 748) | QVQLREWGAGLLKPSETLSLTCTASGFSLSDKAVGWIRQPPGKGLEWLGSIDTGGNTGYNPSLKSRVTISVDTSKNQFSLKLSSVTAADTAVYYC (SEQ ID NO: 749) |

Figure 9

| Designation | VL Amino Acid Sequence |
|---|---|
| VL1-51 S2A, T5N, P8S, A12G, A13S, P14L, K46R, L47T, D51G, N52D, N53T | QAVLNQPSSVSGSLGQKVTISCSGSSSNIGNNYVSWYQQLPGTAPRTLIYGDTKRPSGIPDRFSGSKSGTSATLGITGLQTGDEADYYC (SEQ ID NO: 750) |
| VL1-51 S2A, T5N, P8S, A12G, A13S, P14L, K46R, L47T, D51G, N52D, N53T, K54S, P56A | QAVLNQPSSVSGSLGQKVTISCSGSSSNIGNNYVSWYQQLPGTAPRTLIYGDTSRASGIPDRFSGSKSGTSATLGITGLQTGDEADYYC (SEQ ID NO: 751) |
| VL1-51 I29V, N32G, K46R, L47T, D51G, N52D, N53T | QSVLTQPPSVSAAPGQKVTISCSGSSSNVGNGYVSWYQQLPGTAPRTLIYGDTKRPSGIPDRFSGSKSGTSATLGITGLQTGDEADYYC (SEQ ID NO: 752) |
| VL1-51 I29V, N32G, K46R, L47T, D51G, N52D, N53T, K54S, P56A | QSVLTQPPSVSAAPGQKVTISCSGSSSNVGNGYVSWYQQLPGTAPRTLIYGDTSRASGIPDRFSGSKSGTSATLGITGLQTGDEADYYC (SEQ ID NO: 753) |
| VL1-51 S2A, T5N, P8S, A12G, A13S, P14L, K46R, L47T, D51G, N52D, N53T, with CDR3 in BLV1H12 Light Chain and J region after CDR3 in BLV1H12 Light Chain | QAVLNQPSSVSGSLGQKVTISCSGSSSNIGNNYVSWYQQLPGTAPRTLIYGDTKRPSGIPDRFSGSKSGTSATLGITGLQTGDEADYYCASAEDSSSNAVFGSGTTLTVL (SEQ ID NO: 959) |

Figure 10

| Designation | VH Nucleic Acid Sequence | VH Amino Acid Sequence |
|---|---|---|
| VH4-34+CDR3-IL8_Q5RQ6E | CAGGTGCAGCTAAGAGAGTGGGGCGCAGGACTGTTGAAGCCTTCGGAGACGCTGT CCCTCACCTGCGCTGTCTATGGTGGTTCCTTCAGTGGTTACTACTGGAGCTGGATT CGCCAGCCCCCAGGGAAGGGCTGGAGTGGATTGGGGAAATCAATCATAGTGGAA GCACCAACTACAACCCGTCCCTCAAGAGTCGAGTCACCATATCAGATAGACACGTCC AAGAACCAGTTCTCCCTGAAGCTGAGCTCTGTGACCGCCGGGACACGGCTGTGTA TTACTGTACCTCTGTGCACCAGGAGTCGCATAAAGACATACTCCAAACCTTTCCACCCCAAGTTCAT CAAGGAGCTGAGAGTGATTGAGAGTGGGGAGAGCCTCTGCCTGGACCCACCAGAGATTATTG TAAAGCTTTCTGATGGAGAAGTTCTTGAAGAGGCGTCATGGTGGATGTGTCTGGATGTGCAG AGGGTCGTGTGGTGACAGTTATGAATGGCATGTGTGGATGTGTCTGGTTGACAGTCT CTAGT (SEQ ID NO: 490) | QVQLREWGAGLLKPSETLSLTC AVYGGSFSGYYWSWIRQPPGK GLEWIGEINHSGSTNYNPSLKS RVTISVDTSKNQFSLKLSSVTAA DTAVYYCTSVHQETKKYQSPRS AKELRCQIKTYSKPFHPKFIKE LRVIESGPHCANTEIIVKLSDGR ELCLDPKENWVQRVVEKFLKRA ENSGGSYTYNYEWHVDVWG QGLLVTVSS (SEQ ID NO: 784) |
| VH4-34+CDR3-IL8_CDR1-G31DY32K_Q5RQ6E | CAGGTGCAGCTAAGAGAGTGGGGCGCAGGACTGTTGAAGCCTTCGGAGACGCTGT CCCTCACCTGCGCTGTCTATGGTGGTTCCTTCAGTGACAAGTACTGGAGCTGGATT CGCCAGCCCCCAGGGAAGGGCTGGAGTGGATTGGGGAAATCAATCATAGTGGAA GCACCAACTACAACCCGTCCCTCAAGAGTCGAGTCACCATATCAGATAGACACGTCC AAGAACCAGTTCTCCCTGAAGCTGAGCTCTGTGACCGCCGGGACACGGCTGTGTA TTACTGTACCTCTGTGCACCAGGAGTCGCATAAAGACATACTCCAAACCTTTCCACCCCAAGTTCAT CAAGGAGCTGAGAGTGATTGAGAGTGGGGAGAGCCTCTGCCTGGACCCACCAGAGATTATTG TAAAGCTTTCTGATGGAGAAGTTCTTGAAGAGGCGTCATGGTGGATGTGTCTGGATGTGCAG AGGGTCGTGTGGTGACAGTTATGAATGGCATGTGTGGATGTGTCTGGTTGACAGTCT CTAGT (SEQ ID NO: 491) | QVQLREWGAGLLKPSETLSLTC AVYGGSFSDKYWSWIRQPPGK GLEWIGEINHSGSTNYNPSLKS RVTISVDTSKNQFSLKLSSVTAA DTAVYYCTSVHQETKKYQSPRS AKELRCQIKTYSKPFHPKFIKE LRVIESGPHCANTEIIVKLSDGR ELCLDPKENWVQRVVEKFLKRA ENSGGSYTYNYEWHVDVWG QGLLVTVSS (SEQ ID NO: 785) |

Figure 10 (continued)

| Designation | VH Nucleic Acid Sequence | VH Amino Acid Sequence |
|---|---|---|
| VH4-34+CDR3-IL8_CDR2-E50S_Q5RQ6E | CAGGTGCAGCTAAGAGAGTGGGGCGCAGGACTGTTGAAGCCTTCGGAGACGCTGT CCCTCACCTGCGCTGTCTATGGTGGTGGGTCCTTCAGTGGTTACTACTGGAGCTGGATT CGCCAGCCCCCAGGGAAGGGGCTGGAGTGGATTGGGAGCATCAATCATAGTGGAA GCACCAACTACAACCCGTCCCTCAAGAGTCGAGTCACCATATCAGTAGACACGTCC AAGAACCAGTTCTCCCTGAAGCTGAGCTCTGTGACCGCCGACACGGCTGTGTA TTACTGTACCTCTGTGCACCAGGAAATAAGAACATACTCCAAACCTTTCCACCCAAGTTCAT AGAACTTAGATGTCAGTGCATAAAGACATACTCCAAACCTTTCCACCCAAGTTCAT CAAGGAGCTGAGAGTGATTGAGAGAGTTCTTGAAGAGGGCTGCCAACACAGAGATTATTG TAAAGCTTTCTGATGGGAGAGTTCTTGAAGAGGGCTGCTCCAGCCAGGAGATTATTG AGGGTCGTGGAGAAGTTCTTGAAGAGGGTGGCCAGGGCCGGTTCTTATACAGTCT CTAAATTATGAATGGCATGTGGATGTCGGGGGACAGGGCCTGCTGGTGACAGTCT CTAGT (SEQ ID NO: 492) | QVQLREWGAGILKPSETLSLTC AVYGGSFSGYYWSWIRQPPGK GLEWIGSINHSGSTNYNPSLKS RVTISVDTSKNQFSLKLSSVTAA DTAVYYCTSVHQETKKYQSPRS AKELRCQIKTYSKPFHPKFIKE LRVIESGPHCANTEIIVKLSDGR ELCLDPKENWVQRVVEKFLKRA ENSGSGSYTYNYEWHVDVWG QGLLVTVSS (SEQ ID NO: 786) |
| VH4-34+CDR3-IL8_CDR1-G31DY32K_C DR2-E50S_Q5RQ6E | CAGGTGCAGCTAAGAGAGTGGGGCGCAGGACTGTTGAAGCCTTCGGAGACGCTGT CCCTCACCTGCGCTGTCTATGGTGGTGGGTCCTTCAGTGACAAGTACTGGAGCTGGATT CGCCAGCCCCCAGGGAAGGGGCTGGAGTGGATTGGGAGCATCAATCATAGTGGAA GCACCAACTACAACCCGTCCCTCAAGAGTCGAGTCACCATATCAGTAGACACGTCC AAGAACCAGTTCTCCCTGAAGCTGAGCTCTGTGACCGCCGACACGGCTGTGTA TTACTGTACCTCTGTGCACCAGGAAATAAGAACATACTCCAAACCTTTCCACCCAAGTTCAT AGAACTTAGATGTCAGTGCATAAATTGAGAGAGTTCTTGAAGAGGGTGCCAACACAGAGATTATTG CAAGGAGCTGAGAGTGATTGAGAGAGTTCTTGAAGAGGGCTGCCAACACAGAGATTATTG TAAAGCTTTCTGATGGGAGAGTTCTTGAAGAGGGCTGCTCCAGCCAGGAGATTATTG AGGGTCGTGGAGAAGTTCTTGAAGAGGGTGGCCAGGGCCGGTTCTTATACAGTCT CTAAATTATGAATGGCATGTGGATGTCGGGGGACAGGGCCTGCTGGTGACAGTCT CTAGT (SEQ ID NO: 493) | QVQLREWGAGILKPSETLSLTC AVYGGSFSDKYWSWIRQPPGK GLEWIGSINHSGSTNYNPSLKS RVTISVDTSKNQFSLKLSSVTAA DTAVYYCTSVHQETKKYQSPRS AKELRCQIKTYSKPFHPKFIKE LRVIESGPHCANTEIIVKLSDGR ELCLDPKENWVQRVVEKFLKRA ENSGSGSYTYNYEWHVDVWG QGLLVTVSS (SEQ ID NO: 787) |

Figure 10 (continued)

| Designation | VH Nucleic Acid Sequence | VH Amino Acid Sequence |
|---|---|---|
| VH4-34+CDR3-IL8_CDR1-Cow_Q5RQ6E | CAGGTGCAGCTAAGAGAGAGTGGGGCGCAGGACTGTTGAAGCCTTCGGAGACGCTGT CCCTCACCTGCACAGCCAAGCGGGTTTTCACTGAGCGACAAGGCAGTGGATGGATT CGCCAGCCCCCAGGGAAGGGCTGGAGTGGATTGGGGAAATCAATCATAGTGGAA GCACCAACTACAACCCGTCCCTGAAGAGCTGAGTCGAGTCACCATATCAGTAGACACGTCC AAGAACCAGTTCTCCCTGTGCACCAGAGAGCTGAGCCGCCGGGACACCAGGAGTGCTAA TTACTGTGTACCTCTGTGCACCAGAGTGCATAAAGACATACTCCAAACCTTTCCACCCAAGTTCAT AGAACTTAGATGTCAGTGGATGATTGAGAGTGAGAGAGAGCTCTGCCTGGACCCAAGGAGAGGAAACTGGGTGCAG TAAAGCTTTCTGATGGAGAAGTTCTTGAAGAGGGCTGAGAACTCAGGCAGCGGTTCTTATAC CTACAATTATGAATGGCATGTGGATGTCTGGGGACAGGGCCTGCTGGTGACAGTCT CTAGT (SEQ ID NO: 494) | QVQLREWGAGLLKPSETLSLTC TASGFSLSDKAVGWIRQPPGK GLEWIGEINHSGSTNYNPSLKS RVTISVDTSKNQFSLKLSSVTAA DTAVYYCTSVHQETKKYQSPRS AKELRCQIKTYSKPFHPKFIKE LRVIESGPHCANTEIIVKLSDGR ELCLDPKENWVQRVVEKFLKRA ENSGSGSYTYNYEWHVDVWG QGLLVTVSS (SEQ ID NO: 788) |
| VH4-34+CDR3-IL8_CDR2-Cow_Q5RQ6E | CAGGTGCAGCTAAGAGAGAGTGGGGCGCAGGACTGTTGAAGCCTTCGGAGACGCTGT CCCTCACCTGCGCTGTCTATGGTGGTCTGGGCAGTCGATGCACCGGGGAACAC AGGTCCTTCAGTGGTTACTACTCGGATTGGAGCTGGATCCGCCAGCCCCCAGGGAAGGGG CTGGAGTGGTACAACCCGTCCCTGAAGAGCTCGAGTCACCATATCAGTAGACACGTCC AAGAACCAGTTCTCCCTGTGCACCAGAGTGAGTCTGTGACCGGGACAGCCAAGGAGTGCTA ATTACTGTACCTCTGTGCACCAGAGAAATAAGAAGACATACTCCAAACCTTTCCACCCAAGTTCA AGAACTTAGATGTCAGTGGATTGAGAGTGAGAGAGCTCTGCCTGGACCCAAGGAGAACTGGGTGCA TCAAGGAGCTGAGAAGTTCTTGAAGAGGGCTGAGAACTCAGGCAGCGGTTCTTATA GTAAAGCTTTCTGATGGAGAAGTTCTTGAAGAGGGCTGAGAACTGGGTGTCTTATA GAGGTCGTGGAGAAGTTCTTGAAGAGGCTGAGAACTCAGGCAGCGGTTCTTATA CCTACAATTATGAATGGCATGTGGATGTCTGGGGACAGGGCCTGCTGGTGACAGTC TCTAGT (SEQ ID NO: 495) | QVQLREWGAGLLKPSETLSLTC AVYGGLGSIDTGGNTGSFSGYY WSWIRQPPGKGLEWYNPSLKS RVTISVDTSKNQFSLKLSSVTAA DTAVYYCTSVHQETKKYQSPRS AKELRCQIKTYSKPFHPKFIKE LRVIESGPHCANTEIIVKLSDGR ELCLDPKENWVQRVVEKFLKRA ENSGSGSYTYNYEWHVDVWG QGLLVTVSS (SEQ ID NO: 789) |

Figure 10 (continued)

| Designation | VH Nucleic Acid Sequence | VH Amino Acid Sequence |
|---|---|---|
| VH4-34+CDR3-IL8_CDR1-Cow_CDR2-E50S_Q5RQ6E | CAGGTGCAGCTAAGAGAGTGGGGCGCAGGACTGTTGAAGCCTTCGGAGACGCTGT CCCTCACCTGCACAGCCAAGCGGGTTTTCACTGAGCGACAAGGCAGTGGGATGGATT CGCCAGCCCCCAGGGAAGGGGCTGGAGTGGATTGGGAGCATCAATCATAGTGGAA GCACCAACTACAACCGTCCCTGAAGCTGAGTCACCTCAAGAGTCTCTGTGACCGCCGCGGACACGGGTCTGTGTA AAGAACCAGTTCTCCTGTGCACCAGGAGAAATAAGGAAATACCAGAGCCCAAGGAGTGCTAA TTACTGTACCTCTGTGCACCAGGAGAAATAAGAACATCCAAACCTTCCACCCAAGTCAT AGAACTTAGATGTCAGTGCATAAAGACATACTCCAAACCTTTCCACCCAAGTCAT CAAGGAGCTGAGAGTTGATTGAGAGGCTCTGCCTGGACCCCAAGGAACTCAGGCAG TAAAGCTTTCTGATGGGAGAGCTCTTGAAGAGGCTGAGAACTCAGCAGCGGTTCTTATAC AGGGTCGTGGGAAGTTTCTGATGGCATGTGGATTGTCTGGGACCAGGGCCTGCTGGTGACAGTCT CTAGT (SEQ ID NO: 496) | QVQLREWGAGLLKPSETLSLTC TASGFSLSDKAVGWIRQPPGK GLEWIGSINHSGSTNYNPSLKS RVTISVDTSKNQFSLKLSSVTAA DTAVYYCTSVHQETKKYQSPRS AKELRCQCIKTYSKPFHPKFIKE LRVIESGPHCANTEIIVKLSDGR ELCLDPKENWVQRVVEKFLKRA ENSGSGSYTYNYEWHVDVWG QGLLVTVSS (SEQ ID NO: 790) |
| VH4-34+CDR3-IL8_CDR1-Cow_CDR2-Cow_Q5RQ6E | CAGGTGCAGCTAAGAGAGTGGGGCGCAGGACTGTTGAAGCCTTCGGAGACGCTGT CCCTCACCTGCACAGCCAAGCGGGTTTTCACTGAGCGACAAGGCAGTGGGATGATT CGCCAGCCCCCAGGGAAGGGGCTGGAGTGGCTGGGCAGATCGATACGGAGGGG AACACAGGGTACAACCGTCCCTCAAGAGTCGAGTCACCATCAGTAGACACGTC CAAGAACCAGTTCTCCTGAAGCTGAGCTCTGTGACCGCGGACACGGCTGTGT ATTACTGTACCTCTGTGCACCAGGAGAAATAAGGAAATACCAGAGCCCAAGGAGTGCTA AAGAACTTAGATGTCAGTGCATAAAGACATACTCCAAACCTTTCCACCCCAAGTTCA TCAAGGAGCTGATTGAGAGTGATTGAGAGGCTCTGCCTGGACCCCAAGGAACTCAGGCAG GTAAAGCTTTCTGATGGGAGAGTTCTTGAAGAGGCTGAGAACTCAGCAGCGGTTCTTATA CCTACAATTATGAATGGCATGTGGATGTCTGGGGACAGGGCCTGCTGGTGACAGTC TCTAGT (SEQ ID NO: 497) | QVQLREWGAGLLKPSETLSLTC TASGFSLSDKAVGWIRQPPGK GLEWLGSIDTGGNTGYNPSLKS RVTISVDTSKNQFSLKLSSVTAA DTAVYYCTSVHQETKKYQSPRS AKELRCQCIKTYSKPFHPKFIKE LRVIESGPHCANTEIIVKLSDGR ELCLDPKENWVQRVVEKFLKRA ENSGSGSYTYNYEWHVDVWG QGLLVTVSS (SEQ ID NO: 791) |

Figure 11

| Designation | VL-CL Nucleic Acid Sequence | VL-CL Amino Acid Sequence |
|---|---|---|
| VL1-51 S2A, T5N, P8S, A12G, A13S, P14L, K46R, L47T, D51G, N52D, N53T | CAGGCCGTCCTGAACCAGCCAAGCAGCGTCTCCGGGTCTCTGGGGCAGAAGGTGA CTATCAGCTGCTCTGGCTCATCAAGCAACATCGGGAATAATTACGTCAGCTGGTACC AGCAGCTGCCTGGAACAGCTCCTAGAACCCTCATTTATGGCGACACAAAGCGCCCA TCCGGAATCCCTGACCGATTCAGCGGAAGCAAATCAGGAGCAGATTACTATTGCGCTCTGGG AATCACTGGGCTTCAGACAGGAGATGAGGCAGATTACTACCACTCTTACAGTCCTGAGAGG ACAGCTCCAGCAATGCCGTGCCCCTCGGTGTTCGGTCTGTTCGGGTCACTCTGTTCCGGCCCCTCACTCTGTTCCGGCCCCTCGGTCACTCTGTTCCGCCCCTCACTCTGTTCCGCCCCTCACCCTGATCAGCCTGATCAGC CCCAAGGCTGCCCCTCCGGTGCCCCCACACTGGTCTGTGTCTCATAAGTGACTTCTACCCGGGAGCCGTGACAG CAACAAGGCCACACTGGTCTGTGTCTCATAAGTGACTTCTACCCGGGAGCCGTGACAG TGGCCTGGAAGGCAGATAGCAACAAGTACGGCGGGCAGCAGTATCTGAGCCTGACGCCTG CTCCAAACAAAGCAACAAGTCCCACAGAAGCTACAGTGCCAGTGCCACGAATGTTCA AGCAGTGGAAGAGACAGTGGCCCCTACAGAATGTTCA (SEQ ID NO: 486) | QAVLNQPSSVSGSLGQKVTISC SGSSSNIGNNYVSWYQQLPGT APRTLIYGDTKRPSGIPDRFSGS KSGTSATLGITGLQTGDEADYY CASAEDSSSNAVFGSGTTLTVL GQPKAAPSVTLFPPSSEELQAN KATLVCLISDFYPGAVTVAWKA DSSPVKAGVETTTPSKQSNNKY AASSYLSLTPEQWKSHRSYSC QVTHEGSTVEKTVAPTECS (SEQ ID NO: 780) |
| VL1-51 S2A, T5N, P8S, A12G, A13S, P14L, K46R, L47T, D51G, N52D, N53T, K54S, P56A | CAGGCCGTCCTGAACCAGCCAAGCAGCGTCTCCGGGTCTCTGGGGCAGAAGGTGA CTATCAGCTGCTCTGGCTCATCAAGCAACATCGGGAATAATTACGTCAGCTGGTACC AGCAGCTGCCTGGAACAGCTCCTAGAACCCTCATTTATGGCGACACATCCAGAGCT TCCGGAATCCCTGACCGATTCAGCGGAAGCAAATCAGGAGACCTCTGCCCTCTGCAGAGG AATCACTGGGCTTCAGACAGGAGATGAGGCAGATTACTATTGCGCCTCTGCAGAGG ACAGCTCCAGCAATGCCGTGTTCGGGTCTGTTCGGCCCCCTCACTCTGTTCCGCCCCTCGGTCAGG CCCAAGGCTGCCCCCACACTGGTCTGTGTCTCATAAGTGACTTCTACCCGGGAGCCGTGACAG CAACAAGGCCACACTGGTCTGTGTCTCATAAGTGACTTCTACCCGGGAGCCGTGACAG TGGCCTGGAAGGCAGATAGCAGCAACAAGTACGGCGGGCAGCAGTATCTGAGCCTGACGCCTG CTCCAAACAAAGCAACAAGTCCCACAGAAGCTACAGTGCCAGGTGCCACGAATGTTCA AGCAGTGGAAGAGACAGTGGCCCCCTACAGAATGTTCA (SEQ ID NO: 487) | QAVLNQPSSVSGSLGQKVTISC SGSSSNIGNNYVSWYQQLPGT APRTLIYGDTSRASGIPDRFSGS KSGTSATLGITGLQTGDEADYY CASAEDSSSNAVFGSGTTLTVL GQPKAAPSVTLFPPSSEELQAN KATLVCLISDFYPGAVTVAWKA DSSPVKAGVETTTPSKQSNNKY AASSYLSLTPEQWKSHRSYSC QVTHEGSTVEKTVAPTECS (SEQ ID NO: 781) |

Figure 11 (continued)

| Designation | VL-CL Nucleic Acid Sequence | VL-CL Amino Acid Sequence |
|---|---|---|
| VL1-51 I29V, N32G, K46R, L47T, D51G, N52D, N53T | CAGTCCGTGCTGACCCAACCCCGTCAGTGTCTGCCCGGGCAGAAGGTGA CTATCAGTCGTCTCTGGCTCATCCTCCAATGTCGGCAACGGTACGTCAGTGGTAC CAGCAGCTGCCTGGAACAGCTCCTAGAACCCTCATTTATGGCGACACAAAGCGCCC ATCCGGAATCCCTGACCGATTCAGCGGAAGCAAATCAGGAGACCTCTGCAACTCTGG GAATCACTGGGCTTCAGACAGGAGATGAGGCAGATTACTATTGCGCCTCTGCAGAG GACAGCTCCAGCAATGCCGTTCGGGTCTGTTCCACCACTCTTACAGTCCTAGGTCA GCCCAAGGCTGCCCCTCGGTCACTCTGTTCCCGCCATCTGTGAGGAGCTTCAAG CCAACAAGGCCACACTGGTGTGTCTCATAAGTGACTTCTACCCGGGAGCCGTGACA GTGGCCTGGAAGGCAGATAGCAGCCCCGTCAAGGCGGAGTGGAAACAACCACAC CCTCCAAACAAGTCCCACAGAAGTACGCGGCCAGCTACAGTCTGAGCCTGACGCCT GAGCAGTGGAAGTCCCACAGAAGTACGCGGCCAGTGCCAGGTCACGCATGACGCCT CCGTGGAGAAGACAGTGGCCCCTACAGAATGTTCA (SEQ ID NO: 488) | QSVLTQPPSVSAAPGQKVTISC SGSSSNVGNGYVSWYQQLPGT APRTLIYGDTKRPSGIPDRFSGS KSGTSATLGITGLQTGDEADYY CASAEDSSSNAVFGSGTTLTVL GQPKAAPSVTLFPPSSEELQAN KATLVCLISDFYPGAVTVAWKA DSSPVKAGVETTTPSKQSNNKY AASSYLSLTPEQWKSHRSYSC QVTHEGSTVEKTVAPTECS (SEQ ID NO: 782) |
| VL1-51 I29V, N32G, K46R, L47T, D51G, N52D, N53T, K54S, P56A | CAGTCCGTGCTGACCCAACCCCGTCAGTGTCTGCCCCGGGCAGAAGGTGA CTATCAGTCGTCTCTGGCTCATCCTCCAATGTCGGCAACGGTACGTCAGTGGTAC CAGCAGCTGCCTGGAACAGCTCCTAGAACCCTCATTTATGGCGACACATCCAGAGC TTCCGGAATCCCTGACCGATTCAGCGGAACAGAGATGAGGCAGATTACTATTGCCAACTCTGG GAATCACTGGGCTTCAGACAGGAGATGAGGCAGATTACTATTGCGCCTCTGCAGAG GACAGCTCCAGCAATGCCGTTCGGGTCTGTTCCACCACTCTTACAGTCCTAGGTCA GCCCAAGGCTGCCCCTCGGTCACTCTGTTCCCGCCATCTGTGAGGAGCTTCAAG CCAACAAGGCCACACTGGTGTGTCTCATAAGTGACTTCTACCCGGGAGCCGTGACA GTGGCCTGGAAGGCAGATAGCAGCCCCGTCAAGGCGGGAGTGGAAACAACCACAC CCTCCAAACAAGTCCCACAGAAGTACGCGGCCAGCTACAGTCTGAGCCTGACGCCT GAGCAGTGGAAGAGACAGTGGCCCCTACAGAATGTTCA (SEQ ID NO: 489) | QSVLTQPPSVSAAPGQKVTISC SGSSSNVGNGYVSWYQQLPGT APRTLIYGDTSRASGIPDRFSGS KSGTSATLGITGLQTGDEADYY CASAEDSSSNAVFGSGTTLTVL GQPKAAPSVTLFPPSSEELQAN KATLVCLISDFYPGAVTVAWKA DSSPVKAGVETTTPSKQSNNKY AASSYLSLTPEQWKSHRSYSC QVTHEGSTVEKTVAPTECS (SEQ ID NO: 783) |

Figure 12

| Designation | Amino Acid Sequence |
|---|---|
| Heavy Chain CDR3 Ascending Stalk | TSVHQETKKYQS (SEQ ID NO: 498) |
| Heavy Chain CDR3 Descending Stalk | SYTYNYEWHVDV(SEQ ID NO: 499) |
| BLV1H12 Heavy Chain J region outside of CDR3 | WGQGLLVTVSS(SEQ ID NO: 500) |
| CDR3 in BLV1H12 Light Chain | ASAEDSSSNAV(SEQ ID NO: 754) |
| J region after CDR3 in BLV1H12 Light Chain | FGSGTTLTVL(SEQ ID NO: 755) |
| Human Light Chain Lambda Constant Region | GQPKAAPSVTLFPPSSEELQANKATLVCLISDFYPGAVTVAWKADSSPVKAGVETTTPSK QSNNKYAASSYLSLTPEQWKSHRSYSCQVTHEGSTVEKTVAPTECS(SEQ ID NO: 756) |
| Human Light Chain Lambda Variable Region | QAVLNQPSSVSGSLGQRVSITCSGSSSNVGNGYVSWYQLIPGSAPRTLIYGDTSRASGV PDRFSGSRSGNTATLTISSLQAEDEADYFCASAEDSSSNAVFGSGTTLTVL(SEQ ID NO: 956) |

Figure 13

| Designation | Nucleic Acid Sequence |
|---|---|
| BLV1H12-CDR3-GGS1:1-Bsal | CAGGTCCAGCTGAGAGAGAGCGGGCCCTTCACTGGTCAAGCCATCCCAGACACTG AGCCTGACATGCACAGCCAAGCGGGTTTTCACTGAGCGACAAGGCAGTGGGATGG GTCCGACAGGCACCAGGAAAAGCCCTGGAATGGCTGGGCAGCATCGATACCGG CGGGAACACAGGGTACAATCCCGACTGAAGAGACAGAGACTGTCCATTACCAAGGA CAACTCTAAAAGTCAGGTGTCACCTCTGTGCACCAGGAAACTAAGAAATACCAGAGGATAGT GCAACTTACTATTGCACCTCTGTGCACCAGGAAGCTCTTATACCTACAATTA GAAGCGAGACCTACTATGGTTCGGGTCTCGGAGACAGGGCCTGCTGGTGACAG TGAATGGCATGTGGATGTCTGGGGACAGGGCCTGCTGGTGACAGTCTCTAGTGC TAGC (SEQ ID NO: 757) |
| BLV1H12-CDR3-GGS1:2-Bsal | CAGGTCCAGCTGAGAGAGAGCGGGCCCTTCACTGGTCAAGCCATCCCAGACACTG AGCCTGACATGCACAGCCAAGCGGGTTTTCACTGAGCGACAAGGCAGTGGGATGG GTCCGACAGGCACCAGGAAAAGCCCTGGAATGGCTGGGCAGCATCGATACCGG CGGGAACACAGGGTACAATCCCGACTGTCACTGAGCGTGAGCGTGAGTCCGTGCCACCAGAGGATAGT CAACTCTAAAAGTCAGGTGTCACCTCTGTGCACCAGGAAACTAAGAAATACCAGAGGGAG GAAGCGAGACCTACTATTGAATGGCATGTGGATGTCTGGGGACAGGGCCTGCTGGTGACAG CCTACAATTATGAATGGCATGTGGATGTCTGGGGACAGGGCCTGCTGGTGACAG TCTCTAGTGCTAGC (SEQ ID NO: 758) |
| BLV1H12-CDR3-GGS2:1-Bsal | CAGGTCCAGCTGAGAGAGAGCGGGCCCTTCACTGGTCAAGCCATCCCAGACACTG AGCCTGACATGCACAGCCAAGCGGGTTTTCACTGAGCGACAAGGCAGTGGGATGG GTCCGACAGGCACCAGGAAAAGCCCTGGAATGGCTGGGCAGCATCGATACCGG CGGGAACACAGGGTACAATCCCGACTGTCACTGAGCGTGAGCTCCGTCACCAGAGGATAGT CAACTTACTATTGCACCTCTGTGCACCAGGAAACTAAGAAATACCAGAGGCGGAG GAAGCGGAGGAAGCGAGACCTATGGATGGCATGTGGATGTCTGGAGGAAGCTCTTATA GAAGCGGAGGAAGCGAGACCTATGGTTCGGGTCTCGGAGGAAGCTCTTATA CCTACAATTATGAATGGCATGTGGATGTCTGGGGACAGGGCCTGCTGGTGACAG TCTCTAGTGCTAGC (SEQ ID NO: 759) |

Figure 13 (continued)

| Designation | Nucleic Acid Sequence |
|---|---|
| BLV1H12-CDR3-GGS2.2-Bsal | CAGGTCCAGCTGAGAGAGAGCGGGCCCTTCACTGGTCAAGCCATCCCAGACACTG AGCCTGACATGCACAGCCAAGCAGGGGTTTTCACTGAGCGACAAGGCAGTGGGATGG GTCCGACAGGCACCAGGAAAAGCCCTGGAATGGCTGGGCAGCATCGATACCGG CGGGAACACAGGGTACAATCCCGGACTGAAGAGCAGACTGTCCATTACCAAGGA CAACTCTAAAAGTCAGGTGTCACCTCTGTGCACCTGAGCGTGAGCGTGAGAGGATAGT GCAACTTACTATTGCACCTCTGTGCACCTATGGTTCGGGTCTCGGAGGAAGCGGAGGA GAAGCGGAGGAAGCGGAGACCTACAATTATGAATGGCATGTGGATGTCTGGGACTGC AGCTCTTATACCTAGTCTCTAGTGCTAGC (SEQ ID NO: 760) |
| BLV1H12-CDR3-GGS2.3-Bsal | CAGGTCCAGCTGAGAGAGAGCGGGCCCTTCACTGGTCAAGCCATCCCAGACACTG AGCCTGACATGCACAGCCAAGCAGGGGTTTTCACTGAGCGACAAGGCAGTGGGATGG GTCCGACAGGCACCAGGAAAAGCCCTGGAATGGCTGGGCAGCATCGATACCGG CGGGAACACAGGGTACAATCCCGGACTGAAGAGCAGACTGTCCATTACCAAGGA CAACTCTAAAAGTCAGGTGTCACCTCTGTGCACCTGAGCGTGAGCGTGAGAGGATAGT GCAACTTACTATTGCACCTCTGTGCACCAGGAAACTAAGAAATACCAGAGCGGAG GAAGCGGAGGAAGCGGAGGAAGCTCTTATACCTACAATTATGAATGGCATGTGGATGTCTGGGAC AGGGCCTGCTGGTGACAGTCTCTAGTGCTAGC (SEQ ID NO: 761) |
| BLV1H12-CDR3-GGS2.4-Bsal | CAGGTCCAGCTGAGAGAGAGCGGGCCCTTCACTGGTCAAGCCATCCCAGACACTG AGCCTGACATGCACAGCCAAGCAGGGGTTTTCACTGAGCGACAAGGCAGTGGGATGG GTCCGACAGGCACCAGGAAAAGCCCTGGAATGGCTGGGCAGCATCGATACCGG CGGGAACACAGGGTACAATCCCGGACTGAAGAGCAGACTGTCCATTACCAAGGA CAACTCTAAAAGTCAGGTGTCACCTCTGTGCACCTGAGCGTCCGTCACCACAGAGGATAGT GCAACTTACTATTGCACCTCTGTGCACCAGGAAACTAAGAAATACCAGAGCGGAG GAAGCGGAGGAAGCGGAGGAAGCGGAGAAGCTCTTATACCTACAATTATGAATGGCATGTGGATG TCTGGGACAGGGCCTGCTGGTGACAGTCTCTAGTGCTAGC (SEQ ID NO: 762) |

Figure 13 (continued)

| Designation | Nucleic Acid Sequence |
|---|---|
| BLV1H12-CDR3-GGS3:2-BsaI | CAGGTCCAGCTGAGAGAGAGCGGCCCTTCACTGGTCAAGCCATCCCAGACACTG AGCCTGACATGCACAGCAAGCGGGTTTTCACTGAGCGACAAGGCAGTGGGATGG GTCCGACAGGCACCAGGAAAAGCCCTGGACTGGGCAGCATCGATACCGG CGGGAACACAGGTACAATCCCGGACTGAAGAGCAGAGACTGTCCATTACCAAGGA CAACTCTAAAAGTCAGGTGTCACCTCTGTGCACCAGAGCGTGAGCTCCGTCACCACAGAGGATAGT GCAACTTACTATTGCACCTCTGTGCACCAGGAAACTAAGAATACCAGAGCGGAG GAAGCGGAGGAAGCGGAGAAGCTCTTATACCTAGACAGTCTCTAGTGCTAGC AGGGCCTGCTGGTGACAGTCTCTAGTGCTAGC (SEQ ID NO: 763) |
| BLV1H12-CDR3-GGS3:3-BsaI | CAGGTCCAGCTGAGAGAGAGCGGCCCTTCACTGGTCAAGCCATCCCAGACACTG AGCCTGACATGCACAGCAAGCGGGTTTTCACTGAGCGACAAGGCAGTGGGATGG GTCCGACAGGCACCAGGAAAAGCCCTGGAATGGCTGGGCAGCATCGATACCGG CGGGAACACAGGTACAATCCCGGACTGAAGAGCAGAGACTGTCCATTACCAAGGA CAACTCTAAAAGTCAGGTGTCACCTCTGTGCACCAGAGCGTGAGCTCCGTCACCACAGAGGATAGT GCAACTTACTATTGCACCTCTGTGCACCAGGAAACTAAGAATACCAGAGCGGAG GAAGCGGAGGAAGCGGAGAAGCTCTTATACCTAGACAGTCTCTAGTGCTAGC AGCGGAGGAAGCGGAGGAAGCTCTTATACCTAGACAGTCTCTAGTGCTAGC TCTGGGACAGGGCCTGCTGGTGACAGTCTCTAGTGCATGTGGATG (SEQ ID NO: 764) |
| BLV1H12-CDR3-GGS4:2-BsaI | CAGGTCCAGCTGAGAGAGAGCGGCCCTTCACTGGTCAAGCCATCCCAGACACTG AGCCTGACATGCACAGCAAGCGGGTTTTCACTGAGCGACAAGGCAGTGGGATGG GTCCGACAGGCACCAGGAAAAGCCCTGGAATGGCTGGGCAGCATCGATACCGG CGGGAACACAGGTACAATCCCGGACTGAAGAGCAGAGACTGTCCATTACCAAGGA CAACTCTAAAAGTCAGGTGTCACCTCTGTGCACCAGAGCGTGAGCTCCGTCACCACAGAGGATAGT GCAACTTACTATTGCACCTCTGTGCACCAGGAAACTAAGAATACCAGAGCGGAG GAAGCGGAGGAAGCGGAGGAAGCGAGACCTACTATGGTTCGGT CTCGGAGGAAGCGGAGGAAGCTCTTATACCTACAATTATGAATGGCATGTGGATG TCTGGGACAGGGCCTGCTGGTGACAGTCTCTAGTGCTAGC (SEQ ID NO: 765) |

Figure 13 (continued)

| Designation | Nucleic Acid Sequence |
|---|---|
| BLV1H12-CDR3-G4Sx1-Bsal | CAGGTCCAGCTGAGAGAGAGCGGCCCTTCACTGTCAAGCCATCCCAGACACTG AGCCTGACATGCACAGCCAGTGGTTTTCACTGAGCGACAAGGCAGTGGATGG GTCCGACAGGCACCAGGAAAGCCCTGGAATGGCTGGGCAGCATCGATACCGG CGGGAACACAGGGTACAATCCCGGACTGAAGAGCAGATGTCCATTACCAAGGA CAACTCTAAAAGTCAGGTGTCACCTCTGTGCACCTGAGCGTGAGCTCCACAGAGGATAGT GCAACTTACTATTGCACCTCTGTGCACCAGAAACTAAGAAATACCAGAGCGGTG GAGGAGGTTCTGGAGGATGAGACCTACTATGGTTCAGGTCTCTGGAGGTGGTG GATCTTCTTATACCTACAATTGAATGGCATGTGTCTGGGGACAGGCCT GCTGGTGACAGTCTCTAGTGCTAGC (SEQ ID NO: 766) |
| BLV1H12-CDR3-G4Sx3-Bsal | CAGGTCCAGCTGAGAGAGAGCGGCCCCTTCACTGTCAAGCCATCCCAGACACTG AGCCTGACATGCACAGCCAGTGGTTTTCACTGAGCGACAAGGCAGTGGATGG GTCCGACAGGCACCAGGAAAGCCCTGGAATGGCTGGGCAGCATCGATACCGG CGGGAACACAGGGTACAATCCCGGACTGAAGAGCAGATGTCCATTACCAAGGA CAACTCTAAAAGTCAGGTGTCACCTCTGTGCACCTGAGCGTGAGCTCCACAGAGGATAGT GCAACTTACTATTGCACCTCTGTGCACCAGGAAACTAAGAAATACCAGAGCGGTG GAGGAGGTTCTGGAGGCGGTGGTGGTGGATCTGGAGGTGGGGGAGGTAGCGGAGGATGAGAC CTACTATGGTGGCAGCTCTTATACCTACAATTATGAATGGCATGTGGATGTCTGGGGAC AGGGCCTGCTGGTGACAGTCTCTAGTGCTAGC (SEQ ID NO: 767) |
| Bsal containing Nucleotide sequence I | GAGACCTACTATGGTTCGGGTCTC (SEQ ID NO: 768) |
| Bsal containing Nucleotide sequence II | GAGACCTACTATGGTTCAGGGTCTC (SEQ ID NO: 769) |

Figure 14

| Designation | Amino Acid Sequence |
|---|---|
| BLV1H12-CDR3-GGS1:1-Moka | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGSGINV KCSLPQQCIKPCKDAGMRFGKCMNKKCRCYSGGSSYTYNYEWHVDVWGQGLLVTV SSAS (SEQ ID NO: 770) |
| BLV1H12-CDR3-GGS1:2-Moka | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGSGINV KCSLPQQCIKPCKDAGMRFGKCMNKKCRCYSGGSSYTYNYEWHVDVWGQGL LVTVSSAS (SEQ ID NO: 771) |
| BLV1H12-CDR3-GGS2:1-Moka | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGSGGS GINVKCSLPQQCIKPCKDAGMRFGKCMNKKCRCYSGGSSYTYNYEWHVDVWGQGL LVTVSSAS (SEQ ID NO: 772) |
| BLV1H12-CDR3-GGS2:2-Moka | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGSGGS GINVKCSLPQQCIKPCKDAGMRFGKCMNKKCRCYSGGSSYTYNYEWHVDVWG QGLLVTVSSAS (SEQ ID NO: 773) |
| BLV1H12-CDR3-GGS3:3-Moka | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGSGGSGGS GGSGINVKCSLPQQCIKPCKDAGMRFGKCMNKKCRCYSGGSSGGSGGSSYTYNYEW HVDVWGQGLLVTVSSAS (SEQ ID NO: 774) |
| BLV1H12-CDR3-G4Sx3-ProTxII | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGGGSG GGSGGGGSGGYCQKWMWTCDSERKCCEGMVCRLWCKKKLWGGGGSGGGGS GGGGSSYTYNYEWHVDVWGQGLLVTVSSAS (SEQ ID NO: 775) |
| BLV1H12-CDR3-G4Sx3-GPTX toxin | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGGGSG GGSGGGGSGGDCLGFMRKCIPDNDKCCRPNLVCSRTHKWCKYVFGGGGSGGGG SGGGGSSYTYNYEWHVDVWGQGLLVTVSSAS (SEQ ID NO: 776) |

Figure 14 (continued)

| Designation | Amino Acid Sequence |
|---|---|
| BLV1H12-CDR3-G4Sx3-OSK1 P12, K16, D20 toxin | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGGSG GGGSGGGGSGGGVIINVKCKISPQCLKPCKDAGMRFGKCMNGKCHCTPKGGGGSG GGGSGGGGSSYTYNYEWHVDVWGQGLLVTVSSAS (SEQ ID NO: 777) |
| BLV1H12-CDR3-G4Sx3-OSK1 K16, D20 toxin | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGGSG GGGSGGGGSGGGVIINVKCKISRQCLKPCKDAGMRFGKCMNGKCHCTPKGGGGSG GGGSGGGGSSYTYNYEWHVDVWGQGLLVTVSSAS (SEQ ID NO: 778) |
| BLV1H12-CDR3-G4Sx3-ShK toxin | QVQLRESGPSLVKPSQTLSLTCTASGFSLSDKAVGWVRQAPGKALEWLGSIDTGGN TGYNPGLKSRLSITKDNSKSQVSLSVSSVTTEDSATYYCTSVHQETKKYQSGGGSG GGGSGGGGSGGGRSCIDTIPKSRCTAFQCKHSMKYRLSFCRKTCGTCGGGGGGGGG SGGGGSSYTYNYEWHVDVWGQGLLVTVSSAS (SEQ ID NO: 779) |

Figure 15

| Designation | Amino Acid Sequence | Cross reference Nucleic Acid Sequence |
|---|---|---|
| VL1-51 S2A, T5N, P8S, A12G, A13S, P14L, D51G, N52D, N53T | QAVLNQPSSVSGSLGQKVTISCSGSSSNIGNNYVSWYQQLPGTAPKLLIYG DTKRPSGIPDRFSGSKSGTSATLGITGLQTGDEADYYCASAEDSSSNAVFG SGTTLTVLGQPKAAPSVTLFPPSSEELQANKATLVCLISDFYPGAVTVAWKA DSSPVKAGVETTTPSKQSNNKYAASSYLSLTPEQWKSHRSYSCQVTHEGS TVEKTVAPTECS (SEQ ID NO: 792) | (SEQ ID NO: 444) |
| VH4-34+CDR3-IL8 | QVQLQQWGAGLLKPSETLSLTCAVYGGSFSGYYWSWIRQPPGKGLEWIGE INHSGSTNYNPSLKSRVTISVDTSKNQFSLKLSSVTAADTAVYYCTSVHQET KKYQSPRSAKELRCQCIKTYSKPFHPKFIKELRVIESGPHCANTEIIVKLSDGR ELCLDPKENWVQRVVEKFLKRAENSGSGSYTYNYEWHVDVWGQGLLVTV SSAS (SEQ ID NO: 793) | (SEQ ID NO: 430) |
| VH4-34+CDR3-IL8 Cow | QVQLQQWGAGLLKPSETLSLTCTASGFSLSDKAVGWIRQPPGKGLEWIGEI SIDTGGNTGYNPSLKSRVTISVDTSKNQFSLKLSSVTAADTAVYYCTSVHQETK KYQSPRSAKELRCQCIKTYSKPFHPKFIKELRVIESGPHCANTEIIVKLSDGRE LCLDPKENWVQRVVEKFLKRAENSGSGSYTYNYEWHVDVWGQGLLVTVS SAS (SEQ ID NO: 794) | (SEQ ID NO: 432) |
| VH4-34+CDR3-IL8 Cow | QVQLQQWGAGLLKPSETLSLTCAVYGGSFSDKYVWSWIRQPPGKGLEWLG SIDTGGNTGYNPSLKSRVTISVDTSKNQFSLKLSSVTAADTAVYYCTSVHQE TKKYQSPRSAKELRCQCIKTYSKPFHPKFIKELRVIESGPHCANTEIIVKLSDG RELCLDPKENWVQRVVEKFLKRAENSGSGSYTYNYEWHVDVWGQGLLVT VSSAS (SEQ ID NO: 795) | (SEQ ID NO: 433) |
| VH4-34+CDR3-IL8_CDR1 G31D, Y32K | QVQLQQWGAGLLKPSETLSLTCAVYGGSFSDKYVWSWIRQPPGKGLEWIGE INHSGSTNYNPSLKSRVTISVDTSKNQFSLKLSSVTAADTAVYYCTSVHQET KKYQSPRSAKELRCQCIKTYSKPFHPKFIKELRVIESGPHCANTEIIVKLSDGR ELCLDPKENWVQRVVEKFLKRAENSGSGSYTYNYEWHVDVWGQGLLVTV SSAS (SEQ ID NO: 796) | (SEQ ID NO: 434) |
| VH4-34+CDR3-IL8_CDR2 E50S | QVQLQQWGAGLLKPSETLSLTCAVYGGSFSGYYWSWIRQPPGKGLEWIGS INHSGSTNYNPSLKSRVTISVDTSKNQFSLKLSSVTAADTAVYYCTSVHQET KKYQSPRSAKELRCQCIKTYSKPFHPKFIKELRVIESGPHCANTEIIVKLSDGR ELCLDPKENWVQRVVEKFLKRAENSGSGSYTYNYEWHVDVWGQGLLVTV SSAS (SEQ ID NO: 797) | (SEQ ID NO: 435) |

Figure 15 (continued)

| Designation | Amino Acid Sequence | Cross reference Nucleic Acid Sequence |
|---|---|---|
| VH4-34+CDR3-IL8_CDR1 Cow_CDR2 Cow | QVQLQQWGAGLLKPSETLSLTCTASGFSLSDKAVGWIRQPPGKGLEWLGSI DTGGNTGYNPSLKSRVTISVDTSKNQFSLKLSSVTAADTAVYYCTSVHQETK KYQSPRSAKELRCQCIKTYSKPFHPKFIKELRVIESGPHCANTEIIVKLSDGRE LCLDPKENWVQRVVEKFLKRAENSGSGSYTYNYEWHVDVWGQGLLVTVS SAS (SEQ ID NO: 798) | (SEQ ID NO: 436) |
| VH4-34+CDR3-IL8_CDR1 Cow_CDR2 E50S | QVQLQQWGAGLLKPSETLSLTCTASGFSLSDKAVGWIRQPPGKGLEWIGSI NHSGSTNYNPSLKSRVTISVDTSKNQFSLKLSSVTAADTAVYYCTSVHQETK KYQSPRSAKELRCQCIKTYSKPFHPKFIKELRVIESGPHCANTEIIVKLSDGRE LCLDPKENWVQRVVEKFLKRAENSGSGSYTYNYEWHVDVWGQGLLVTVS SAS (SEQ ID NO: 799) | (SEQ ID NO: 437) |
| VH4-34+CDR3-IL8_CDR1 G31D,Y32K_CDR2 E50S | QVQLQQWGAGLLKPSETLSLTCAVYGGSFSDKYWSWIRQPPGKGLEWIGS INHSGSTNYNPSLKSRVTISVDTSKNQFSLKLSSVTAADTAVYYCTSVHQET KKYQSPRSAKELRCQCIKTYSKPFHPKFIKELRVIESGPHCANTEIIVKLSDGR ELCLDPKENWVQRVVEKFLKRAENSGSGSYTYNYEWHVDVWGQGLLVTV SSAS (SEQ ID NO: 800) | (SEQ ID NO: 439) |
| VL1-51 I29V, N32G | QSVLTQPPSVSAAPGQKVTISCSGSSSNVGNGYVSWYQQLPGTAPKLLIYD NNKRPSGIPDRFSGSKSGTSATLGITGLQTGDEADYYCASAEDSSSNAVFG SGTTLTVLGQPKAAPSVTLFPPSSEELQANKATLVCLISDFYPGAVTVAWKA DSSPVKAGVETTTPSKQSNNKYAASSYLSLTPEQWKSHRSYSCQVTHEGS TVEKTVAPTECS (SEQ ID NO: 801) | (SEQ ID NO: 440) |
| VL1-51 D51G, N52D, N53T | QSVLTQPPSVSAAPGQKVTISCSGSSSNIGNNYVSWYQQLPGTAPKLLIYGD TKRPSGIPDRFSGSKSGTSATLGITGLQTGDEADYYCASAEDSSSNAVFGS GTTLTVLGQPKAAPSVTLFPPSSEELQANKATLVCLISDFYPGAVTVAWKAD SSPVKAGVETTTPSKQSNNKYAASSYLSLTPEQWKSHRSYSCQVTHEGST VEKTVAPTECS (SEQ ID NO: 802) | (SEQ ID NO: 441) |
| VL1-51 D51G, N52D, N53T, K54S, P56A | QSVLTQPPSVSAAPGQKVTISCSGSSSNIGNNYVSWYQQLPGTAPKLLIYGD TSRASGIPDRFSGSKSGTSATLGITGLQTGDEADYYCASAEDSSSNAVFGS GTTLTVLGQPKAAPSVTLFPPSSEELQANKATLVCLISDFYPGAVTVAWKAD SSPVKAGVETTTPSKQSNNKYAASSYLSLTPEQWKSHRSYSCQVTHEGST VEKTVAPTECS (SEQ ID NO: 803) | (SEQ ID NO: 442) |

Figure 15 (continued)

| Designation | Amino Acid Sequence | Cross reference Nucleic Acid Sequence |
|---|---|---|
| VL1-51 S2A, T5N, P8S, A12G, A13S, P14L | QAVLNQPSSVSGSLGQKVTISCSGSSSNIGNNYVSWYQQLPGTAPKLLIYD NNKRPSGIPDRFSGSKSGTSATLGITGLQTGDEADYYCASAEDSSSNAVFG SGTTLTVLGQPKAAPSVTLFPPSSEELQANKATLVCLISDFYPGAVTVAWKA DSSPVKAGVETTTPSKQSNNKYAASSYLSLTPEQWKSHRSYSCQVTHEGS TVEKTVAPTECS (SEQ ID NO: 804) | (SEQ ID NO: 443) |
| VL1-51 | QSVLTQPPSVSAAPGQKVTISCSGSSSNIGNNYVSWYQQLPGTAPKLLIYDN NKRPSGIPDRFSGSKSGTSATLGITGLQTGDEADYYCASAEDSSSNAVFGS GTTLTVLGQPKAAPSVTLFPPSSEELQANKATLVCLISDFYPGAVTVAWKAD SSPVKAGVETTTPSKQSNNKYAASSYLSLTPEQWKSHRSYSCQVTHEGST VEKTVAPTECS (SEQ ID NO: 805) | (SEQ ID NO: 456) |
| Lambda LC translation | QAVLNQPSSVSGSLGQRVSITCSGSSSNVGNGYVSWYQLIPGSAPRTLIYG DTSRASGVPDRFSGSRSGNTATLTISSLQAEDEADYFCASAEDSSSNAVFG SGTTLTVLGQPKAAPSVTLFPPSSEELQANKATLVCLISDFYPGAVTVAWKA DSSPVKAGVETTTPSKQSNNKYAASSYLSLTPEQWKSHRSYSCQVTHEGS TVEKTVAPTECS (SEQ ID NO: 807) | (SEQ ID NO: 474) |

Figure 16

| SEQ ID NO: | Amino Acid Sequence |
|---|---|
| 575 | GGGGS |
| 576 | GGGGS GGGGS |
| 577 | GGGGS GGGGS GGGGS |
| 578 | GGGGS GGGGS GGGGS GGGGS |
| 579 | GGS |
| 580 | GGS GGS |
| 581 | GGS GGS GGS |
| 582 | GGS GGS GGS GGS |
| 583 | ASG |
| 584 | ASG ASG |
| 585 | ASG ASG ASG |
| 586 | ASG ASG ASG ASG |
| 587 | GCGGGGS |
| 588 | GCGGGGS GGGGS |
| 589 | GCGGGGS GGGGS GGGGS |
| 590 | GCGGGGS GGGGS GGGGS GGGGS |
| 591 | GCGGS |
| 592 | GCGGS GGS |
| 593 | GCGGS GGS GGS |
| 594 | GCGGS GGS GGS GGS |
| 595 | GCASG |
| 596 | GCGCASG ASG |
| 597 | GCASG ASG ASG |
| 598 | GCASG ASG ASG ASG |
| 699 | SGGGG |
| 700 | SGGGG SGGGG |
| 701 | SGGGG SGGGG SGGGG |
| 702 | SGGGG SGGGG SGGGG SGGGG |
| 703 | SGG |
| 704 | SGG SGG |
| 705 | SGG SGG SGG |

Figure 16 (continued)

| SEQ ID NO: | Amino Acid Sequence |
|---|---|
| 706 | SGG SGG SGG SGG |
| 707 | GSA |
| 708 | GSA GSA |
| 709 | GSA GSA GSA |
| 710 | GSA GSA GSA GSA |
| 711 | SGGGGCG |
| 712 | SGGGGG SGGGGCG |
| 713 | SGGGGG SGGGGG SGGGGCG |
| 714 | SGGGGG SGGGGG SGGGG SGGGGCG |
| 715 | SGGCG |
| 716 | SGG SGGCG |
| 717 | SGG SGG SGGCG |
| 718 | SGG SGG SGG SGGCG |
| 719 | GSACG |
| 720 | GSA GSACGCG |
| 721 | GSA GSA GSACG |
| 722 | GSA GSA GSA GSACG |
| 723 | GGGGS GG |
| 724 | GGGGS GGGGS GGGGS GG |
| 725 | GG SGGGG |
| 726 | GG SGGGG SGGGG GGGGS |
| 813 | G |
| 814 | GG |
| 815 | GGG |
| 816 | GGGG |
| 817 | GGGGGSGGS |
| 818 | GGGGSGGGGSGG |
| 819 | GGGGSGGS |
| 820 | GGGGSGGSGGS |
| 821 | GGGGSGGGGSGGS |
| 822 | GGSG |
| 823 | GGSGG |

Figure 16 (continued)

| SEQ ID NO: | Amino Acid Sequence |
|---|---|
| 824 | GGSGGSG |
| 825 | GGSGGGSGG |
| 826 | GGSGGGGGSG |
| 827 | GGSGGGSGGSGG |
| 828 | GGSGGGSGGGSGGSGG |
| 829 | GSG |
| 830 | GSGG |

Figure 17

| Peptide Name | Amino Acid Sequence | Target |
|---|---|---|
| ADWX-1 | VGINVKCKHSRQCLKPCKDAGMRFGKCTNGKCHCTPK (SEQ ID NO: 599) | Kv1.3 |
| HsTx1 | ASCRTPKDCADPCRKETGCPYGKCMNRKCKCNRC (SEQ ID NO: 600) | Kv1.3 |
| OSK1 | GVIINVKCKISRQCLEPCKKAGMRFGKCMNGKCHCTPK (SEQ ID NO: 601) | Kv1.3 |
| Pi2 | TISCTNPKQCYPHCKKETGYPNAKCMNRKCKCFGR (SEQ ID NO: 602) | Kv1.3 |
| Hongotoxin (HgTX) | TVIDVKCTSPKQCLPPCKAQFGIRAGAKCMNGKCKCYPH (SEQ ID NO: 603) | Kv1.3 |
| Margatoxin | TIINVKCTSPKQCLPPCKAQFGQSAGAKCMNGKCKCYPH (SEQ ID NO: 604) | Kv1.3 |
| Agitoxin-2 | GVPINVSCTGSPQCIKPCKDAGMRFGKCMNRKCHCTPK (SEQ ID NO: 605) | Kv1.3 |
| Pi3 | TISCTNEKQCYPHCKKETGYPNAKCMNRKCKCFGR (SEQ ID NO: 606) | Kv1.3 |
| Kaliotoxin | GVEINVKCSGSPQCLKPCKDAGMRFGKCMNRKCHCTPK (SEQ ID NO: 607) | Kv1.3 |
| Anuroctoxin | ZKECTGPQHCTNFCRKNKCTHGKCMNRKCKCFNCK (SEQ ID NO: 608) | Kv1.3 |
| Charybdotoxin | ZFTNVSCTTSKECWSVCQRLHNTSRGKCMNKKCRCYS (SEQ ID NO: 609) | Kv1.3 |
| Tityustoxin -K- alpha | VFINAKCRGSPECLPKCKEAIGKAAGKCMNGKCKCYP (SEQ ID NO: 610) | Kv1.3 |
| Maurotoxin | VSCTGSKDCYAPCRKQTGCPNAKCINKSCKCYGC (SEQ ID NO: 611) | Kv1.3 |
| Ceratotoxin 1 (CcoTx1) | DCLGWFKSCDPKNDKCCKNYTCSRRDRWCKYDL (SEQ ID NO: 612) | |
| CcoTx2 | DCLGWFKSCDPKNDKCCKNYTCSRRDRWCKYYL (SEQ ID NO: 613) | |
| CcoTx3 | GVDKEGCRKLLGGCTIDDDCCPHLGCNKKYWHCGWDGTF (SEQ ID NO: 614) | |
| Phrixotoxin 3 (PaurTx3) | DCLGFLWKCNPSNDKCCRPNLVCSRKDKWCKYQI (SEQ ID NO: 615) | |

Figure 17 (continued)

| Peptide Name | Amino Acid Sequence | Target |
|---|---|---|
| Hanatoxin 1 | ECRYLFGGCKTTSDCCKHLGCKFRDKYCAWDFTFS (SEQ ID NO: 616) | |
| Phrixotoxin 1 | YCQKWMWTCDSARKCCEGLVCRLWCKKII (SEQ ID NO: 617) | |
| Huwentoxin-IV | ECLEIFKACNPSNDQCCKSSKLVCSRKTRWCKYQI (SEQ ID NO: 618) | |
| α-conotoxin ImI | GCCSDPRCAWRC (SEQ ID NO: 619) | |
| α-conotoxin EpI | GCCSDPRCNMNNPDYC (SEQ ID NO: 620) | |
| α-conotoxin PnIA | GCCSLPPCAANNPDYC (SEQ ID NO: 621) | |
| α-conotoxin PnIB | GCCSLPPCALSNPDYC (SEQ ID NO: 622) | |
| α-conotoxin MII | GCCSNPVCHLEHSNLC (SEQ ID NO: 623) | |
| α-conotoxin AuIA | GCCSYPPCFATNSDYC (SEQ ID NO: 624) | |
| α-conotoxin AuIB | GCCSYPPCFATNPDC (SEQ ID NO: 625) | |
| α-conotoxin AuIC | GCCSYPPCFATNSGYC (SEQ ID NO: 626) | |
| conotoxin κ-PVIIA | CRIPNQKCFQHLDDCCSRKCNRFNKCV (SEQ ID NO: 627) | |
| charybdotoxin | ZFTNVSCTTSKECWSVCQRLHNTSRGKCMNKKCRCYS (SEQ ID NO: 628) | |
| neurotoxin B-IV | ASATWGAAYPACENNCRKKYDLCIRCQGKWAGKRGKCAAHCIIQKNNCKG KCKKE (SEQ ID NO: 629) | |
| crotamine | YKQCHKKGGHCFPKEKICLPPSSDFGKMDCCRWRWKCCKKGSG (SEQ ID NO: 630) | |
| ω-GVIA (conotoxin) | CKSPGSSCSPTSYNCCRSCNPYTKRCY (SEQ ID NO: 631) | |
| κ-hefutoxin 1 | GHACYRNCWREGNDEETCKERC (SEQ ID NO: 632) | |

Figure 17 (continued)

| Peptide Name | Amino Acid Sequence | Target |
|---|---|---|
| Css4 | KEGYLVNSYTGCKFECFKLGDNDYCLRECRQQYGKGSSGGYCYAFGCWCT HLYEQAVVWPLPNKTCN (SEQ ID NO: 633) | |
| Bj-xtrIT | KKNGYPLDRNGKTTECSGVNAIAPHYCNSECTKVYVAESGYCCWGACYCF GLEDDKPIGPMKDITKKYCDVQIIPS (SEQ ID NO: 634) | |
| BcIV | GLPCDCHGHTGTYWLNYYSKCPKGYGYTGRCRYLVGSCCYK (SEQ ID NO: 635) | |
| Hm-1 | GCIPYGKTCEFWSGPWCCAGKCKLNVWSMTLSCTRNF (SEQ ID NO: 636) | |
| Hm-2 | GCIPSFGECAWFSGESCCTGICKWFFTSKFMCRRVWGKD (SEQ ID NO: 637) | |
| GsAF-I (β-theraphotoxin-Gr1b) | YCQKWLWTCDSERKCCEDMVCRLWCKKRL (SEQ ID NO: 638) | |
| Protoxin I (ProTx-I, β-theraphotoxin-Tp1a) | ECRYWLGGCSAGQTCCKHLVCSRRHGWCVWDGTFS (SEQ ID NO: 639) | |
| Protoxin II (ProTx II) | YCQKWMWTCDSERKCCEGMVCRLWCKKLW (SEQ ID NO: 640) | |
| Huwentoxin I | ACKGVFDACTPGKNECCPNRVCSDKHKWCKWKL (SEQ ID NO: 641) | |
| μ-Conotoxin PIIIA | ERLCCGFPKSCRSRQCKPHRCC (SEQ ID NO: 642) | |
| Jingzhaotoxin-III (β-TRTX-Cj1α) | DGECGGFWWKCGRGKPPCCKGYACSKTWGWCAVEAP (SEQ ID NO: 643) | |
| GsAF-II (Kappa-theraphotoxin-Gr2c) | YCQKWMWTCDEERKCCEGLVCRLWCKKKIEW (SEQ ID NO: 644) | |
| ShK, K16,E30 | RSCIDTIPKSRCTAFKCKHSMKYRLSFCRETCGTC (SEQ ID NO: 645) | |
| ShK (Stichodactyla toxin) | RSCIDTIPKSRCTAFQCKHSMKYRLSFCRKTCGTC (SEQ ID NO: 646) | Kv1.3 |
| HsTx1 | ASCRTPKDCADPCRKETGCPYGKCMNRKCKCNRC (SEQ ID NO: 647) | |
| Guangxitoxin 1E, GxTx-1E | EGECGGFWWKCGSGKPACCPKYVCSPKWGLCNFPMP (SEQ ID NO: 648) | |
| Charybdotoxin, ChTX | EFTNVSCTTSKECWSVCQRLHNTSRGKCMNKKCRCYS (SEQ ID NO: 649) | |

Figure 17 (continued)

| Peptide Name | Amino Acid Sequence | Target |
|---|---|---|
| Iberiotoxin, IbTx | EFTDVDCSVSKECWSVCKDLFGVDRGKCMGKKCRCYQ (SEQ ID NO: 650) | |
| Leiurotoxin 1, scyllatoxin | AFCNLRMCQLSCRSLGLLGKCIGDKCECVKH (SEQ ID NO: 651) | |
| Tamapin | AFCNLRRCELSCRSLGLLGKCIGEECKCVPY (SEQ ID NO: 652) | |
| Kaliotoxin-1, KTX | GVEINVKCSGSPQCLKPCKDAGMRFGKCMNRKCHCTPK (SEQ ID NO: 653) | |
| Purotoxin1, PT-1 | GYCAEKGIRCDDIHCCTGLKCKCNASGYNCVCRKK (SEQ ID NO: 654) | |
| GpTx-1 | DCLGFMRKCIPDNDKCCRPNLVCSRTHKWCKYVF (SEQ ID NO: 655) | Nav1.7 |
| MOKA Toxin | INVKCSLPQQCIKPCKDAGMRFGKCMNKKCRCYS (SEQ ID NO: 727) | |
| OSK1, P12, K16, D20 | GVIINVKCKISPQCLKPCKDAGMRFGKCMNGKCHCTPK (SEQ ID NO: 728 ) | Kv1.3 |
| OSK1 K16, D20 | GVIINVKCKISRQCLKPCKDAGMRFGKCMNGKCHCTPK (SEQ ID NO: 729) | Kv1.3 |
| HmK | RTCKDLIPVSECTDIRCRTSMKYRLNLCRKTCGSC (SEQ ID NO: 730) | Kv1.3 |
| ShK, K16,Y26, K29 | RSCIDTIPKSRCTAFKCKHSMKYRLYFCKKTCGTC (SEQ ID NO: 731) | Kv1.3 |
| ShK, K16 | RSCIDTIPKSRCTAFKCKHSMKYRLSFCRKTCGTC (SEQ ID NO: 732) | Kv1.3 |
| ShK-A, K16 | RSCIDTIPKSRCTAFKCKHSMKYRLSFCRKTCGTCA (SEQ ID NO: 733) | Kv1.3 |
| Shk toxin | GVPDRFSGSRSGNTATLTISSLQAEDEADYFCASAEDSSSNAVFGSGTTLT VLGQPKAAP (SEQ ID NO: 808) | |
| ProTxII toxin | SVTLFPPSSEELQANKATLVCLISDFYPGAVTVAWKADSSPVKAGVETTTPS KQSNNKYA (SEQ ID NO: 809) | |
| GPTX toxin | ASSYLSLTPEQWKSHRSYSCQVTHEGSTVEKTVAPTECS (SEQ ID NO: 810) | |
| ShK, Q21 | RSCIDTIPKSRCTAFQCKHSQKYRLSFCRKTCGTC (SEQ ID NO: 831) | Kv1.3 |

FIGURE 17 (continued)

| Peptide Name | Amino Acid Sequence | Target |
|---|---|---|
| ShK, L21 | RSCIDTIPKSRCTAFQCKHSLKYRLSFCRKTCGTC (SEQ ID NO: 832) | Kv1.3 |
| ShK, F21 | RSCIDTIPKSRCTAFQCKHSFKYRLSFCRKTCGTC (SEQ ID NO: 833) | Kv1.3 |
| ShK, I21 | RSCIDTIPKSRCTAFQCKHSIKYRLSFCRKTCGTC (SEQ ID NO: 834) | Kv1.3 |
| ShK, A21 | RSCIDTIPKSRCTAFQCKHSAKYRLSFCRKTCGTC (SEQ ID NO: 835) | Kv1.3 |

Figure 17 (continued)

| Toxin | Block 1 Seq | Linker A Seq | Block 2 Seq | Linker B Seq | Block 3 Seq |
|---|---|---|---|---|---|
| ADWX-1 | VGINVKCKHSR (SEQ ID NO: 666) | QC | LKPCKDAGMRFG (SEQ ID NO: 677) | KCM | NGKCHCTPK (SEQ ID NO: 688) |
| HsTx1 | ASCRTPK (SEQ ID NO: 667) | QC | ADPCRKETGCPYG (SEQ ID NO: 678) | KCM | NRKCKCNRC (SEQ ID NO: 689) |
| OSK1 | GVIINVKCKISR (SEQ ID NO: 668) | QC | LEPCKKAGMRFG (SEQ ID NO: 679) | KCM | NGKCHCTPK (SEQ ID NO: 690) |
| Pi2 | TISCTNPK (SEQ ID NO: 669) | QC | YPHCKKETGYPNA (SEQ ID NO: 680) | KCM | NRKCKCFGR (SEQ ID NO: 691) |
| Hongotoxin (HgTX) | TVIDVKCTSPK (SEQ ID NO: 670) | QC | LPPCKAQFGIRAGA (SEQ ID NO: 681) | KCM | NGKCKCYPH (SEQ ID NO: 692) |
| Margatoxin | TIINVKCTSPK (SEQ ID NO: 671) | QC | LPPCKAQFGQSAGA (SEQ ID NO: 682) | KCM | NGKCKCYPH (SEQ ID NO: 693) |
| Agitoxin-2 | GVPINVSCTGSP (SEQ ID NO: 672) | QC | IKPCKDAGMRFG (SEQ ID NO: 683) | KCM | NRKCHCTPK (SEQ ID NO: 694) |
| Pi3 | TISCTNEK (SEQ ID NO: 673) | QC | YPHCKKETGYPNA (SEQ ID NO: 684) | KCM | NRKCKCFGR (SEQ ID NO: 695) |
| Kaliotoxin | GVEINVKCSGSP (SEQ ID NO: 674) | QC | LKPCKDAGMRFG (SEQ ID NO: 685) | KCM | NRKCHCTPK (SEQ ID NO: 696) |
| Anuroctoxin | ZKECTGPQ (SEQ ID NO: 675) | QC | TNFCRKNKCTHG (SEQ ID NO: 686) | KCM | NRKCKCFNCK (SEQ ID NO: 697) |
| Charybdotoxin | ZFTNVSCTTSK (SEQ ID NO: 676) | QC | WSVCQRLHNTSRG (SEQ ID NO: 687) | KCM | NKKCRCYS (SEQ ID NO: 698) |

Figure 18

| Designation | Nucleic Acid Sequence |
|---|---|
| MOKA Toxin | GGCATCAACGTGAAGTGCAGCCTGCCCCAGCAGCCTGCATGCAGTGCATCAAGCCCTGCAAGGAGGCCCGGCATGAGATTCGGCAA GTGCATGAACAAGAAGTGCAGATGCAGATGCTACAGC (SEQ ID NO: 806) |
| OSK1 toxin (P12, K16, D20) | GGCGTGATCATCAACGTGAAATGCAAGATCAGCCGCCAGTGCCTGAAGCCCTGCAAGGACGCGGCATGAGGTT CGGGAAGTGCATGAACGGCAAGTGCCACTGCACCCCAAG (SEQ ID NO: 811) |
| OSK1 toxin (K16 and D20) | GGCGTGATCATCAACGTGAAGTGCAGATCAGCCGCCAGTGCCTGAAGCCCTGCAAGGACGCGGCATGAGGTT CGGTAAGTGCATGAACGGCAAGTGCCACTGCACCCCAAG (SEQ ID NO: 812) |

Figure 19

| Ab Name | Ultralong CDR3 | | | V2 region |
|---|---|---|---|---|
| | A region | Insert | D region | |
| PGT145 | GSKHRLRDYFLYNE (SEQ ID NO: 501) | | YGPNYEEWGDYLATLDV (SEQ ID NO: 536) | WGHGTAVTVSS (SEQ ID NO: 570) |
| | GSKHRLRDYFLYN (SEQ ID NO: 502) | | GPNYEEWGDYLATLDV (SEQ ID NO: 537) | |
| | GSKHRLRDYFLY (SEQ ID NO: 503) | | PNYEEWGDYLATLDV (SEQ ID NO: 538) | |
| | GSKHRLRDYFL (SEQ ID NO: 504) | | NYEEWGDYLATLDV (SEQ ID NO: 539) | |
| | GSKHRLRDYF (SEQ ID NO: 505) | | YEEWGDYLATLDV (SEQ ID NO: 540) | |
| | GSKHRLRDY (SEQ ID NO: 506) | | EEWGDYLATLDV (SEQ ID NO: 541) | |
| | GSKHRLRD (SEQ ID NO: 507) | | | |
| PG9 | EAGGPDYRNGYNY (SEQ ID NO: 508) | | YDFYDGYYNYHYMDV (SEQ ID NO: 542) | WGKGTTVTVSS (SEQ ID NO: 571) |
| | EAGGPDYRNGYN (SEQ ID NO: 509) | | DFYDGYYNYHYMDV (SEQ ID NO: 543) | |
| | EAGGPDYRNGY (SEQ ID NO: 510) | | FYDGYYNYHYMDV (SEQ ID NO: 544) | |
| | EAGGPDYRNG (SEQ ID NO: 511) | | YDGYYNYHYMDV (SEQ ID NO: 545) | |
| | EAGGPDYRN (SEQ ID NO: 512) | | DGYYNYHYMDV (SEQ ID NO: 546) | |
| | EAGGPDYR (SEQ ID NO: 513) | | GYYNYHYMDV (SEQ ID NO: 547) | |

Figure 19 (continued)

| Ab Name | Ultralong CDR3 | | | V2 region |
|---|---|---|---|---|
| | A region | Insert | D region | |
| PG16 | EAGGPDY (SEQ ID NO: 514) | | YYNYHYMDV (SEQ ID NO: 548) | |
| | EAGGPD (SEQ ID NO: 515) | | | WGKGTTVTVSS (SEQ ID NO: 572) |
| | EAGGPIWHDDVKY (SEQ ID NO: 516) | | YDFNDGYYNYHYMDV (SEQ ID NO: 549) | |
| | EAGGPIWHDDVK (SEQ ID NO: 517) | | DFYDGYYNYHYMDV (SEQ ID NO: 550) | |
| | EAGGPIWHDDV (SEQ ID NO: 518) | | FYDGYYNYHYMDV (SEQ ID NO: 551) | |
| | EAGGPIWHDD (SEQ ID NO: 519) | | YDGYYNYHYMDV (SEQ ID NO: 552) | |
| | EAGGPIWHD (SEQ ID NO: 520) | | DGYYNYHYMDV (SEQ ID NO: 553) | |
| | EAGGPIWH (SEQ ID NO: 521) | | GYYNYHYMDV (SEQ ID NO: 554) | |
| | EAGGPIW (SEQ ID NO: 522) | | | |
| | EAGGPI (SEQ ID NO: 523) | | | |
| CHO4 | GTDYTIDDQGI (SEQ ID NO: 524) | | QGIRYQGSGTFWYFDV (SEQ ID NO: 555) | |
| | GTDYTIDDQG (SEQ ID NO: 525) | | GIRYQGSGTFWYFDV (SEQ ID NO: 556) | WGRGTLVTVSS (SEQ ID NO: 573) |
| | GTDYTIDDQ (SEQ ID NO: 526) | | IRYQGSGTFWYFDV (SEQ ID NO: 557) | |
| | GTDYTIDD (SEQ ID NO: 527) | | RYQGSGTFWYFDV (SEQ ID NO: 558) | |

Figure 19 (continued)

| Ab Name | Ultralong CDR3 | | | |
|---|---|---|---|---|
| | A region | Insert | D region | V2 region |
| 2909 | GTDYTID (SEQ ID NO: 528) | | YQGSGTFWYFDV (SEQ ID NO: 559) | |
| | GTDYTI (SEQ ID NO: 529) | | QGSGTFWYFDV (SEQ ID NO: 560) | |
| | | | GSGTFWYFDV (SEQ ID NO: 561) | |
| | | | SGTFWYFDV (SEQ ID NO: 562) | |
| | | | GTFWYFDV (SEQ ID NO: 563) | |
| | DKGDSDYDYNL (SEQ ID NO: 530) | | YNLGYSYFYYMDG (SEQ ID NO: 564) | WGKGTTVTVSS (SEQ ID NO: 574) |
| | DKGDSDYDYN (SEQ ID NO: 531) | | NLGYSYFYYMDG (SEQ ID NO: 565) | |
| | DKGDSDYDY (SEQ ID NO: 532) | | LGYSYFYYMDG (SEQ ID NO: 566) | |
| | DKGDSDYD (SEQ ID NO: 533) | | GYSYFYYMDG (SEQ ID NO: 567) | |
| | DKGDSDY (SEQ ID NO: 534) | | YSYFYYMDG (SEQ ID NO: 568) | |
| | DKGDSD (SEQ ID NO: 535) | | SYFYYMDG (SEQ ID NO: 569) | |

Figure 21

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 201 | BLV1H12 GGS1.1 ProTxII | BLV1H12 HC GGS1.1 ProTxII | 131-34 | caggtcagctgagagagagcggccctcactgtcaagccatccc agacactgagcctgacatgggtcacagcaagcggttttcactgagcga caaggcagtgggatggtcgacagcaccaggacacaggtccctgg aatggctgggcagcatcgatacggcgggaacacaggtacaatc ccgactgaagagcagactgtccattaccaaggacaactctaaaa gtcaggtgtcactgagcgtgagctccgtcaccacagaggatagtc aactactattgcacctgtgccagaagaaactaagaaatac gcgaggaagctaltgccagaaggatgtgacctgcgatagcg aacggaaatgtgcgaaggcatgttgtcgcgcctggtgcaagaa gaaactctgggagaacaggcccctggtgacagtctagtgctagc | 836 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSYCQKW MWTCDSERKCCEGMVCRL WCKKKLWGGSSYTNYEW HVDVWGQGLLVTVSSAS | 903 |
| 202 | BLV1H12 GGS1.2 ProTxII | BLV1H12 HC GGS1.2 ProTxII | 131-35 | caggtcagctgagagagagcggccctcactgtcaagccatccc agacactgagcctgacatgggtcacagcaagcggttttcactgagcga caaggcagtgggatggtcgacagcaccaggacacaggtccctgg aatggctgggcagcatcgatacggcgggaacacaggtacaatc ccgactgaagagcagactgtccattaccaaggacaactctaaaa gtcaggtgtcactgagcgtgagctccgtcaccacagaggatagtc aactactattgcacctgtgccagaagaaactaagaaatac gcgaggaagctaltgccagaaggatgtgacctgcgatagcg aacggaaatgtgcgaaggcatgttgtcgcgcctggtgcaagaa gaaactctgggagcatgatgtctgggacaggcctgctggtgacagtctc tagtgctagc | 837 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSYCQKW MWTCDSERKCCEGMVCRL WCKKKLWGGSGGSSYTYN YEWHVDVWGQGLLVTVSS AS | 904 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 203 | BLV1H12 GGS2:1 ProTxII | BLV1H12 HC GGS2:1 ProTxII | 131-36 | caggtccagctgagagagagcggccctcactgtcaagccatccc agacactgagcctgacatggtcagacaaggcggtttcactgacga caaggcagtggggtcgacatgggtcgacgaggcaccaggaaaagccctgg aatggctgggcagcatcgatacggcgggaacacaggtacaatc ccggactgaagacgcagactgtccattaccaaggacaactctaaaa gtcaggtgtcactgagcgtgagctccgtcaccagaggatagtgc aacttactattgcaacctctgtgccaccagaaactaagaaatacccaga gcggaggaagcgaacgaaatgtgcaaggcatgtgtgccgcctgtg gtgcaagaagaacctgggatgttctctggggaggacagggcctgtg aatgcatgtgatgtctatacaatatg agtgctagc | 838 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGSGSYC QKWMWTCDSERKCCEGMV CRLWCKKLWGGSSYTYN YEWHVDVWGQGLLVTVSS AS | 905 |
| 32, 204 | BLV1H12 GGS1:1 Moka | BLV1H12 Hc CowV,HuC 1:1GGS G-Moka | 131-40 | caggtccagctgagagagagcggccctcactgtcaagccatccc agacactgagcctgacatggtcagacaaggcggtttcactgacga caaggcagtggggtcgacatgggtcgacgaggcaccaggaaaagccctgg aatggctgggcagcatcgatacggcgggaacacaggtacaatc ccggactgaagacgcagactgtccattaccaaggacaactctaaaa gtcaggtgtcactgagcgtgagctccgtcaccagaggatagtgc aacttactattgcaacctctgtgccaccagaaactaagaaatacccaga gcggaggaagcgaacatcaacgtgaagtgcagcgcccagag tgcatcaagccctgcaaggacgcggcatgacggaagctcttatacct acaattatgaatgcatgtggatgtctgggacagggcctgctggtg acagtctagtgctagc | 839 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGSGINVKC SLPQQCIKPCKDAGMRFGK CMNKKCRCYSGGSSYTYN YEWHVDVWGQGLLVTVSS AS | 770 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 30, 205, 227 | BLV1H12 GGS1.2 Moka | BLV1H12 Hc CowV,HuC 1.2GGS G-Moka | 131-41 | caggtccagctgagagagcggcccttcactgtcaagccatccc agaacactgagcctgacatggcagcggtttcactgagcga caaggcagtggggctccgacaaggcaccaggaaaagcccgg aatgctgggcagcatcgatactggtaacacaggtacaatc ccggactgaagaacactgtccatttaccaaggacaactctaaaa gtcaggtgctcactgagcgtgagcctcgtcaccacagagtgc aactactatgccacctctgtgccaccaggaaaactaagaatccaga gcggaggaagcggaaagccgcatcaacgtgaagtgcagcct gcccagagtgcatgaacaagacctgcaagagcgccggcatagag gctcatatcctacactaacaattatgaatgcatgtgatgtctgggagagg gcctgctgctggtgacagtctctagtgctagc | 840 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGINVKC SLPQQCIKPCKDAGMRFGK CMNKKCRCYSGSGSSY TYNYEWHVDVWGQGLLVT VSSAS | 771 |
| 31, 206 | BLV1H12 GGS2.1 Moka | BLV1H12 Hc CowV,HuC 2.1GGS G-Moka | 131-42 | caggtccagctgagagagcggcccttcactgtcaagccatccc agaacactgagcctgacatggcagcggtttcactgagcga caaggcagtggggctccgacaaggcaccaggaaaagcccgg aatgctgggcagcatcgatactggtaacacaggtacaatc ccggactgaagaacactgtccatttaccaaggacaactctaaaa gtcaggtgctcactgagcgtgagcctcgtcaccacagagtgc aactactatgccacctctgtgccaccaggaaaactaagaatccaga gcggaggaagcggaaagccccatcaacgtgaagtgcagcct gcccagagtgcatgaacaagacctgcaagagcgccatgagatt cggcaagtgcatgaacaagagtgcagatgccggcatacagggagaa gctcatatcctacactaacaattatgaatgcatgtgatgtctgggagagg gcctgctgctggtgacagtctctagtgctagc | 841 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGSGSGIN VKCSLPQQCIKPCKDAGMR FGKCMNKKCRCYSGGSSYT YNYEWHVDVWGQGLLVTV SSAS | 772 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 33, 41, 207 | BLV1H12 GGS3.3 Moka | BLV1H12 Hc CowV,HuC 3.3GGS G-Moka | 131-43 | caggtccagctgagagagagcggccctcactgtcaagccatccc agacactgagctgacatgtgcacagcaaggcagggttttcactgagcga caaggcagtggcatgggtccgacagcgccaggaacaccgggtacaatc ccggactgaagagagcagactgtccattaccaaggacaactctaaaa gtcaggtgtcactgagcgtgactccgtcaccacagaggatagtc aacttactattgcacctctgtgcaccaggaaaactaagaaataccaga gcggaggaagcgctccccagtgcatcaagccctgcaaggacgtga agtcagccgccccaagtgcatgaacaagaagtgcagatgctaca gcatgagattcggcaagtgcatgaacaagaagtgcagatgctaca atgaatggcatgtggatgttggggacaggcctgctggtgacagtc tctagtgctagc | 842 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSGSGG SGINVKCSLPQQCIKPCKDA GMRFGKCMNKKCRCYSGG SGSGGSSYTYNYEWHVD VWGQGLLVTVSSAS | 774 |
| 208 | BLV1H12 GGS1:1 GG-ProTxII-GG | BLV1H12 HC GGS1:1 GG-ProTxII-GG | 131-37 | caggtccagctgagagagagcggccctcactgtcaagccatccc agacactgagctgacatgtgcacagcaaggcagggttttcactgagcga caaggcagtggcatgggtccgacagcgccaggaacaccgggtacaatc ccggactgaagagagcagactgtccattaccaaggacaactctaaaa gtcaggtgtcactgagcgtgactccgtcaccacagaggatagtc aacttactattgcacctctgtgcaccaggaaaactaagaaataccaga gcggaggaagcgcgtattgccaaggcatggtgatggccgcctggtg atagcgaaatctgggcggcggaggaagcttatacctacaa ttatgaatggcatggatgtctgggacaggcctgctggtgacagt ctcagtgctagc | 843 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGGGYCQ KWMWTQDSERKCCEGMVC RLWCKKLWGGGSSYTY NYEWHVDVWGQGLLVTVS SAS | 906 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 209 | BLV1H12 GGS1.2 GG-ProTxII-GG | BLV1H12 HC GGS1.2 GG-ProTxII-GG | 131-38 | caggtccagctgagagagagcggccctcactgtcaagccatccc agacactgagcctgacatggtcagcaggcgggtttcactgagcga caaggcagtggatggtccgacagcaggcaccaggaaaagcccg aatggctgggcagcatcgatacggcgggaacacaggtacaatc ccggactgaagacgcagactgtccattaccaaggacaactctaaaa gtcaggtgtcactgagcgtgagctccgtcaccacaggagatagtc aacttactactgtgcaccctgtgccaggaaaactaagaaataccaga gcggaggaagcggcggctattgccagaagttgatgtgaccgctgcg atagcgaacgaaatctgggtcgggcggaagcggaggaagctctt ataccacaattatgaatgcatgtgtgatctgggacagggcctg ctggtgacagtctctagtgtctagc | 844 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGSGYCQ KWMWTCDSERKCCEGMVC RLWCKKKLWGGGSGGSS YTYNYEWHVDVWGQGLLV TVSSAS | 907 |
| 210 | BLV1H12 GGS2.1 GG-ProTxII-GG | BLV1H12 HC GGS2.1 GG-ProTxII-GG | 131-39 | caggtccagctgagagagagcggccctcactgtcaagccatccc agacactgagcctgacatggtcagcaggcgggtttcactgagcga caaggcagtggatggtccgacagcaggcaccaggaaaagcccg aatggctgggcagcatcgatacggcgggaacacaggtacaatc ccggactgaagacgcagactgtccattaccaaggacaactctaaa gtcaggtgtcactgagcgtgagctccgtcaccacaggagatagtc aacttactattgcaccctgtgccaggaaaactaagaaataccaga gcggaggaagcggaaagcggcgctattgccagaagtggatg tggaacctgcgatagcgaacggaaatgtttcgaaggcatgtgtgcc gcctgtggtgcaagaagaaactctggggcgggcggaggaagctctt ataccacaattatgaatggcatgtgatgtctggggacagggcctg ctggtgacagtctctagtgtctagc | 845 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGSGSGG YCQKWMWTCDSERKCCEG MVCRLWCKKKLWGGGGSS YTYNYEWHVDVWGQGLLV TVSSAS | 908 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 211 | BLV1H12 GGS2.2 ProTxII | BLV1H12 HC GGS2.2 ProTxII | 131-44 | caggtccagctgagagagcggcccttcactggtcaagccatccc agacactgagcctgacatggcagcatcaagcgggttttcactgagcga caaggcagtggtgatggtcgacaggcgcaccaggaaagccctgg aatgctggggcagcatgatccggcggaacacaggtacaatc ccggactgaagagcagactgtccattaccaaggacactctaaaa gtcaggtgtcactgagctgagctcgtcaccagaggatagtgc aacttactattgcacctctgtcaccagaaactaagaaataccaga gcgaggaagcggaggaagctattgccagaagtgatgtgacct gcgatagcgaacgaaatgttgcaagccatgtcgccgctgtg gtgcaagagaaactgggaggaagcggaggaagcggaggctctaac ctacaattatgcatgtgacagtctctagtgctgctagc | 846 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSGGSYC QKWMWTCDSERKCCEGMV CRLWCKKKLWGGSGGSSY TYNYEWHVDVWGQGLLVT VSSAS | 909 |
| 212 | BLV1H12 GGS2.4 ProTxII | BLV1H12 HC GGS2.4 ProTxII | 131-45 | caggtccagctgagagagcggcccttcactggtcaagccatccc agacactgagcctgacatggcagcatcaagcgggttttcactgagcga caaggcagtggtgatggtcgacaggcgcaccaggaaagccctgg aatggctgggcagcatgatccggcggaacacaggtacaatc ccggactgaagagcagactgtccattaccaaggacactctaaaa gtcaggtgtcactgagctgagctcgtcaccagaggatagtgc aacttactattgcacctctgtcaccagaaactaagaaataccaga gcgaggaagcggaggaagctattgccagaagtgatgtgacct gcgatagcgaacggaaatgttgcaagccatgtcgccgctgtg gtgcaagagaaactgggaggaagcggaggaagcggaggctctaac ctacaattatgcctatacctacaattatgcatgtgacagtctctagtgctagc | 847 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSGGSYC QKWMWTCDSERKCCEGMV CRLWCKKKLWGGSGGSGG SGGSSYTYNYEWHVDVWG QGLLVTVSSAS | 910 |

FIGURE 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 213 | BLV1H12 GGS2.2 GG-ProTxII-GG | BLV1H12 HC GGS4.2 ProTxII | 131-46 | caggtccagctgagagagcggccctcactgtcaagccatccc agacactgagcctgacatgcacagcaagcgggtttcactgagcga caaggcagtggatggtccgacatccggaacacaggtacaatctaaaa ccggaactgggcagcagactgtccattaccaaggacaactctaaaa gtcagtggtcactgagcgtgagtcctgtcaccacagaggatagtgc aacttactattgcacctgtgccaggaaactaagaaataccaga gcggaggaagtgcgagagcgaggaagcgaagctatt gccagaagtgatgtgaacctgcgatagcgaacgaacgaagctatt aagcatgtgtgccgcctggtgcaaggaagaaactctgggag ggaagcgagaagctctatacctataatttgtgacagtctagtgcgagc gtctgggggacagggcctgctggtgacagtctagtgcgagc | 848 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGSGG SGGSYCQKVMWTCDSERK CCEGMVCRLWCKKLWGG SGGSYTYNYEWHVDVWG QGLLVTVSSAS | 911 |
| 214 | BLV1H12 GGS2.2 GG-ProTxII-GG | BLV1H12 HC GGS2.2 GG-ProTxII-GG | 131-47 | caggtccagctgagagagcggccctcactgtcaagccatccc agacactgagcctgacatgcacagcaagcgggtttcactgagcga caaggcagtggatggtccgacatccggaacacaggtacaatc cggaactgggcagcagactgtccattaccaaggacaactctaaaa gtcagtggtcactgagcgtgagtcctgtcaccacagaggatagtgc aacttactattgcacctgtgccaggaaactaagaaataccaga gcggaggaagtgcgagagcgaggcggctattgccagagtggatg tgaacctgcgatagcgaacgaaatgttgcgaaggcatgtgtgcc gcctgtggtgcaagaagaaactctactaattatgaatgcatgtgtagc ggaagctctatacctataatttgtgacagtctagtgcgagc caggccctgctgctggtgacagtctagtgcgagcgga | 849 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGSGSGSGG YCQKVMWTCDSERKCCEG MVCRLWCKKLWGGGGSG GSSYTYNYEWHVDVWGQG LLVTVSSAS | 912 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 215 | BLV1H12 GGS 2:3 GG-ProTxII-GG | BLV1H12 HC GGS 2:3 GG-ProTxII-GG | 131-48 | caggtccagctgagagagagcggccccttcactgtcaagccatcccagacactgagcctgacatgcacagcaagcgggtttcactgacgacaaggcagtggcagtggtccgacagcgccaccaggagaaagcccctgaatgctggcagcatcgatacggcgggaacacaggtacaatccggactgaaggacactgtccattaccaaggacaactctaaaagtcaggtgtcactgagcgtgactccgtcaccagaggatagtgtgaacttactattgcaccctctgtgcaggaagcggcgctatttgccgaaatgtgggccatggcgggaaatatgtgcaaggagtcgtgaggcgggaacgaaacgaaactctgggcgcggaggaacgatgcacgcctggtggcgggaaaggcagggccctgtcgtgacagtctctagc | 850 | QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGSGSGGYCQKWMWTCDSERKCCEGMVCRLWCKKLWGGGSGGSGGSGSSYTNYEWHVDVWGQGLLVTVSSAS | 913 |
| 216 | BLV1H12 GGS 2:4 GG-ProTxII-GG | BLV1H12 HC GGS 2:4 GG-ProTxII-GG | 131-49 | caggtccagctgagagagagcggccccttcactgtcaagccatcccagacactgagcctgacatgcacagcaagcgggtttcactgacgacaaggcagtggcagtggtccgacagcgccaccaggagaaagcccctgaatgctggcagcatcgatacggcgggaacacaggtacaatccggactgaaggacactgtccattaccaaggacaactctaaaagtcaggtgtcactgagcgtgactccgtcaccagaggatagtgtaacttactattgcaccctctgtgcaggaagcggcgctatttgccgaaatgtgggccatggcgggaaatatgtgcaaggagtcgtgaggcgggaacgaaacgaaactctgggcgcggaggaacgagccctgtggtgatgtctgggggacagggcctgtgctgtgacagtctctagtgctagc | 851 | QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGSGSGGYCQKWMWTCDSERKCCEGMVCRLWCKKLWGGGSGGSGGSGGSSYTNYEWHVDVWGQGLLVTVSSAS | 914 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 217 | BLV1H12 GGS 3:2 GG-ProTxII-GG | BLV1H12 HC GGS 3:2 GG-ProTxII-GG | 131-50 | caggtcagctgagagagcggcccttcactgtcaagccatccc agacactgagcctgacatgggtccgacaagcgggtttcactgacga caaggcagtggatgggtccgacatcgatacggtacaatc ccggactgaagagacagactgtccattaccaagacaactctaaaa gtcaggtgtcactgagcgtgagctccgtcaccagaggatagtgc aactactattgcacctctgtgccaaggaaactaagaaaataccaga gcggaggaagcggaggaagcggaggaagcggctattgccaa gaagtggatggaccctgtgtgcaagaagaaactgtggggggg catggtgtgccgctggtgccatctctatcctgtgtgacagtctagtcag aggaaagcggaggaaacaggggcacaggggcgcgggg atgtctggggacagggccctgctgtgacagtctctagc | 852 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSGGSGG SGGYCQKWMWTCDSERKC CEGMVCRLWCKKLWGGG GSGGSGGSSYTYNYEWHV GQGLLVTVSSAS | 915 |
| 218 | BLV1H12 GGS 3:3 GG-ProTxII-GG | BLV1H12 HC GGS 3:3 GG-ProTxII-GG | 131-51 | caggtcagctgagagagcggcccttcactgtcaagccatccc agacactgagcctgacatgggtccgacaagcgggtttcactgacga caaggcagtggatgggtccgacatcgatacggtacaatc ccggactgaagagacagactgtccattaccaagacaactctaaaa gtcaggtgtcactgagcgtgagctccgtcaccagaggatagtgc aactactattgcacctctgtgccaaggaaactaagaaaataccaga gcggaggaagcggaggaagcggaggaagcggctattgccaa gaagtggatgcgctggtgcaagaagaaactgtgggggcgg aggaagcggaggaagcggaggacaggggacaggggtgggg atggcatgtgatgtctgggacaggagtctctatacctacaattatga gtgctagc | 853 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSGGSGG SGGYCQKWMWTCDSERKC CEGMVCRLWCKKLWGGG GSGGSGGSSYTYNYEWHV DVWGQGLLVTVSSAS | 916 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 219 | BLV1H12 GGS 4.2 GG-ProTxII-GG | BLV1H12 HC GGS 4.2 GG-ProTxII-GG | 131-52 | caggtccagtgagagagcggcccttcactgtcaagccatccc agacactgagcctgacatgcacagccaagcgggtttcactgagcga caaggcagtggatgggtccgacaggcaccaggaaagccctgg aatggctgggcagcatcgatacggctcgggaacacaggtacaatc ccggactgaagacagactgtccattaccagtccgtcaccacagagagatgc gtcaggtgtcactgagctgagctccgtcaccacagaggatgc aacttactattgcacctctgtgcaccaggaaactaagaaataccaga gcggagaaggcagcggagaaggcgaggaagcggagaagcggc ggctattgccagaggtcatgtgtccgcctgtggtcaagagaaactg gttgcgaaggcagcggagaaggcggagaagctctatccacaattatga ggcggcggaaggcagcggagaacagggctgcggtgacagtctcta gtgctagc | 854 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSGSGG SGGSGGYCQKWMWTCDS ERKCCEGMVCRLWCKKKL WGGGSGGSSYTYNYEWH VDVWGQGLLVTVSSAS | 917 |
| 220 | BLV1H12 GTLV 3xG4S ProTxII | BLV1H12 GTLV 3xG4S ProTxII | 131-56 | caggtccagtgagagagcggcccttcactgtcaagccatccc agacactgagcctgacatgcacagccaagcgggtttcactgagcga caaggcagtggatgggtccgacaggcaccaggaaagccctgg aatggctgggcagcatcgatacggctcgggaacacaggtacaatc ccggactgaagacagactgtccattaccagtccgtcaccacagaggatgc gtcaggtgtcactgagctgagctccgtcaccacagaggatgc aacttactattgcacctctgtgcaccaggaaactaagaaataccaga gcggtggaggagttctggagggtggtggaagtggtggcgaggta gcggagatactgccagagggtggaccctgcgacacgag aggaagtgctgcagaggtcatgtggatcgtgtgcaggctgtgcaagaag ggtggcagctgttataccactacaattataatgcatgtggatgtctggg gccaaggaacccctggtcaccgtcctcagctagc | 855 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGSGSGG GSGGGSGGYCQKWMWT CDSERKCCEGMVCRLWCK KKLWGGGSGGGGSGGG GSSYTYNYEWHVDVWGQG TLVTVSSAS | 918 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 221 | BLV1H12 GTLV 3xG4S ShK | BLV1H12 GTLV 3xG4S ShK | 131-59 | caggtccagctgagagagaggcggccttcactgtcaagccatcc agacactgagcctgacatgtggtccgacagcaagcgggtttcactgagcga caaggcagtgggcagcatcgatacggcgggaacacaggtacaatc aatgctgggcagcatcgatacggcgggaacacaggtacaatc ccgactgaaagagcagactgtccattaccaaggacaactctaaaa gtcaggtgtcactgagcgtgagctccgtcaccagaggatgtc aacttactattgcacctgtgaggcgttcggagtggtgcggagta gcggtggagaggagctgcatgacacagccatcccaagagccgatgc gcgcccttccagtgcaagcacacagcaggtacacaggtgagctct gcaggaagacctgcggcacctgcggagtggtgatcggtggag gaggcagtgaggtgtgccaaggaaccctgtcctcctcagc tagc | 856 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGGSGGG GSGGGGSGGRSCIDTIPKS RCTAFQCKHSMKYRLSFCR KTCGTCGGGSGGGGSGGG GGSSYTYNYEWHVDVWGQ GTLVTVSSAS | 919 |
| 222 | BLV1H12 GTLV 3xG4S OSK1 (K16, D20) | BLV1H12 GTLV 3xG4S OSK1 (K16, D20) | 131-60 | caggtccagctgagagagaggcggccttcactgtcaagccatcc agacactgagcctgacatgtggtccgacagcaagcgggtttcactgagcga caaggcagtgggcagcatcgatacggcgggaacacaggtacaatc ccgactgaaagagcagactgtccattaccaaggacaactctaaaa gtcaggtgtcactgagcgtgagctccgtcaccagaggatgtc aacttactattgcacctgtgaggcgttcggagtggtgcggagta gcggtggagaggagcctgaacgtgatcatcaacgtgaagttcgagatcagcagg cagtgcctgaagcctgcactgcacccccaaggagctgttcgttaagt gcatgaacggccaagtgcagtgcaggtggtgcagctcttatacctacaat tatgaatgcatgtgatgtctgggatcggggccaaggaaccctgtcaccgt ctcctcagctagc | 857 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGGSGGG GSGGGGSGGVIINVKCKIS RQCLKPCKDAGMRFGKCM NGKCHCTPKGGGGSGGGG SGGGGSSYTYNYEWHVDV WGQGTLVTVSSAS | 920 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 223 | BLV1H12 GTLV 3xG4S OSK1 (P12,K16,D 20) | BLV1H12 GTLV 3xG4S OSK1 (P12,K16,D 20) | 131-61 | caggtccagctgagagagagcggcccttcactgtcaagccatccc agacactgagcctgacatgcacagcaggtttcactgagcga caaggcagtgggcatcgacaaggcaccaggaaagcccctgg aatggctgggcagcatcgataccggcgggaacacaggtacaatc ccggactgaagagcagactgtccattaccaaggacaactctaaaa gtcagtgtcacttgagcgtgagctccgtcaccacagaggatagtc aacttactactgtgcacctgtgcacctgagtccggtgaacgtaaccaga gcggtggaggaggttctggaggcggttgaagtgggcggaggta gcggtggaggaggtgtatcatcaaacgtgaaatgcaagatcagccccc agtcctgaagcctgcaagagacgccggcatgaggtttcggaagt gcatgaaacgcaagatgccactgcagtgtgcagctcttatacctacaat ctgttgagagagagcaagtgcagtgaggtcgctggggggtaggggggat tatgaatggcatgttcatgtctgggggccaaggaaccctgtcaccgt ctcctcagctagc | 858 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGSGGGG GSGGGGSGGGVIINVKCKIS PQCLKPCKDAGMRFGKCM NGKCHCTPKGGGGSGGGG SCGGGSSYTNYEWHVDV WGQGTLVTVSSAS | 921 |
| 79, 224 | BLV1H12 GTLV 3xG4S GpTx-1 | BLV1H12 cowV HumanC 3xG4S GPTX | 131-62 | caggtccagctgagagagagcggcccttcactgtcaagccatccc agacactgagcctgacatgcacagcaggtttcactgagcga caaggcagtgggcatcgacaaggcaccaggaaagcccctgg aatggctgggcagcatcgataccggcgggaacacaggtacaatc ccggactgaagagcagactgtccattaccaaggacaactctaaaa gtcagtgtcacttgagcgtgagctccgtcaccacagaggatagtc aacttactactgtgcacctgtgcacctgagtccggtgaacgtaaccaga gcggtggaggaggttctggaggcggttgaagtgggcggaggta gcggtggaggaggactgctgggcttcatgaggaagtgcatcccgaca acgacaagtgctgcaggcccaacctgtgtgcagctgggaggaggag aagtggtcaagtaggtgtggccagctcttataccatacaatatgaatgcatg tggatgtctgggggccaaggaaccctgtcaccgtctcctcagctagc | 859 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGSGGGG GSGGGGSGGDCLGFMRKC IPDNDKCCRPNLVCSRTHK WCKYVFGGGSGGGGSG GGGSSYTNYEWHVDVWG QGTLVTVSSAS | 922 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 225 | BLV1H12 GTLV 6xG4S | BLV1H12 GTLV 6xG4S | 131-64 | caggtccagctgagagagcgccttcactgtcaagccatcc agacactgagcctgacatgcacagcaagcggtttcactgacga caaggcagtggggtccgacaggcaccaggaaaagcccctgg aatggctggtgcagcatcgataccggcggaacacaggtacaatc ccggactgaaagagcagactgtccattaccaagacactctaaaa gtcaggtgtcactgagcgtgagctccgtcaccagaggatagtgc aacttactattgcaccctgtgcaccaggaaaactaagaaataccaga gcggtggaggaggttctggaggcggtggaagtggcagtggaggtgtggc agctctataccacaattgaatgcatgtggatgtggatgtctgggccaa ggaaccctggtcaccgtctcctcagctagc | 860 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGGSGGG GSGGGGSGGGGSGGGGS GGGGSSYTYNYEWHVDVW GQGTLVTVSSAS | 923 |
| 226 | BLV1H12 GTLV 1xG4S Bsals (wStop) | BLV1H12 GTLV 1xG4S Bsals (wStop) | 131-65 | caggtccagctgagagagagcgccttcactgtcaagccatccc agacactgagcctgacatgcacagcaagcggtttcactgacga caaggcagtggggtccgacaggcaccaggaaaagcccctgg aatggctgggcagcatcgataccggcggaacacaggtacaatc ccggactgaaagagcagactgtccattaccaagacaactctaaaa gtcaggtgtcactgagcgtgagctccgtcaccagaggatagtgc aacttactattgcaccctgtgcaccaggatgagacctactatgttcaggtc tctgaaggtggtgatcttctataccactacaatattgaatggcatgtgga tgtctgggccaaggaacctggtcaccgtctcctcagctagc | 861 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGGSGG' DLLWFRVSGGGSSYTYNY EWHVDVWGQGTLVTVSSA S | 924 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 25, 228 | BLV1H12 GLLV 3xG4S ProTxII | BLV1H12 GLLV 3xG4S ProTxII | 131-66 | caggtccagctgagagagagcggcccttcactgtcaagccatcccagacactgagcctgacatggtccacagcaaggcggtttcactgagcgacaaggcagtggatggtccgacatgacgcggaacacaggcccctgaatggctggcagcatgatacggcgggaacactgggtacaactctaaaaccggactgaagacagagcagactgtccattaccaaggacaactctaaaagtcaggtgtcactgagcgtgagctccgtcaccagaggatgtcaactactattgcacctctgtgcaccaggaaactaagaaataccagagcggtggagaggttctgagggcggtggaagtggtggcgacagcgagaggaagtgctgcgagggcatggtggatctgtcagggagccgtgatggcagaaagctgtggggagggcctctggggaggcggtggaagcagagggccctgctggtgggacagtctctagtgctagc | 862 | QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGSSGGGSGGGSSGGYCQKWMWTCDSERKCCEGMVCRLWCKKKLWGGGSGGGGSGGGGSSYTYNYEWHVDVWGQLLVTVSSAS | 775 |
| 29, 40, 229 | BLV1H12 GLLV 3xG4S ShK | BLV1H12 Hc CowV,HuC GLLV 3xG4S ShKtoxin | 131-67 | caggtccagctgagagagagcggcccttcactgtcaagccatcccagacactgagcctgacatggtccacagcaaggcggtttcactgagcgacaaggcagtggatggtccgacatgacgcggaacacaggcccctgaatggctggcagcatgatacggcgggaacactgggtacaactctaaaaccggactgaagacagagcagactgtccattaccaaggacaactctaaaagtcaggtgtcactgagcgtgagctccgtcaccagaggatgtcaactactattgcacctctgtgcaccaggaaactaagaaataccagagcggtggagaggttctgagggcggtggaagtggtggcgacagcgatgcaccgcctccagtgcaagcacatgaagtacaggctgagctctgcaggaagacctgcgccatccagtgcaaggtggtgatcaggtctgcagctgatctggtgaggaggcagtgagggttgtgcagctctatcctacaatagctgaatgcatgtggatgtgggaaggccctgctgggacagtctctagtgctagc | 863 | QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGSGGGSGGGSSGGGSGGRSCIDTIPKSRCTAFQCKHSMKYRLSFCRKTCGTCGGGSGGGGSGGGGSSYTYNYEWHVDVWGQGLLVTVSSAS | 779 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 26, 230 | BLV1H12 GLLV 3xG4S OSK1 (K16,D20) | BLV1H12 GLLV 3xG4S OSK1 (K16,D20) | 131-68 | caggtccagctgagagagagcggcccttcactgtcaagccatccc agacactgagcctgacatggtggtcacagcaaggcggtttcactgagcga caaggcagtggcagcatcgatacggtcgggaacacaggtacaatc ccgactgaagacagagctggctgagctcgtcaccacagagatagtgc gtcaggtgtcactgaggtgagctgtgtcaccagagatagtgc aacttactacttgtcacctgtgcaccaggaaactaagaaaataccaga gccggtggagaggcgtgatcatcaacgtgaagtgcaagatcagcagg gcgcctgaagccctgcaagtgccactgcaaggacgccggcatgaggttcggtaagt cagtgcctgaagccctgcaaggtccactgcaaggacgccggcatgaggttcggtaagt gcatgaaccgcaagtgccactgcaaggtggtgagctcttatacctacaat tatgaatggcatgtgatgtctgggggacagggcctgtgacagt ctctagtgctagc | 864 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGSGGG GSGGGSGGGVIINVKCKIS RQCLKPCKDAGMRFGKCM NGKCHCTPKGGGSGGGG SGGGSSYTYNYEWHVDV WGQGLLVTVSSAS | 778 |
| 27, 231 | BLV1H12 GLLV 3xG4S OSK1 (P12,K16,D 20) | BLV1H12 GLLV 3xG4S OSK1 (P12,K16,D20) | 131-69 | caggtccagctgagagagagcggcccttcactgtcaagccatccc agacactgagcctgacatggtggtcacagcaaggcggtttcactgagcga caaggcagtggcagcatcgatacggtcgggaacacaggtacaatc ccgactgaagacagagctgtcattaccaaggacaactctaaaa gtcaggtgtcactgaggtgagctcgtcaccacagagatagtgc aacttactacttgtcacctgtgcaccaggaaactaagaaaataccaga gccggtggagaggcgtgatcatcaacgtgaaatgcaagatcagcccc agtgcctgaagccctgcaagtgccactgcaaggacgccggcatgaggttcggaagt gcatgaaccgcaagtgccactgcaaggtggtgagctcttatacctacaat tatgaatggcatgtgatgtctgggggacagggcctgtgacagt ctctagtgctagc | 865 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGSGGG GSGGGSGGGVIINVKCKIS PQCLKPCKDAGMRFGKCM NGKCHCTPKGGGSGGGG SGGGSSYTYNYEWHVDV WGQGLLVTVSSAS | 777 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 28, 232 | BLV1H12 GLLV 3xG4S GpTx-1 | BLV1H12 GLLV 3xG4S GpTx-1 | 131-70 | caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggagactgcctgggcttcatgaggaagtgcatccccgacaacgacaagtgctgcaggcccaacctggtgtgcagcaggacccacaagtggtgcaagtacgtgttcggaggtggtggatctggtggaggaggcagtggaggtggtggcagctcttatacctacaattatgaatggcatgtggatgtctggggacagggcctgctggtgacagtctctagtgctagc | 866 | QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGDCLGFMRKCIPDNDKCCRPNLVCSRTHKWCKYVFGGGGSGGGGSGGGGSSYTYNYEWHVDVWGQGLLVTVSSAS | 776 |
| 34 | VH4-34 MutA IL-8 CD1Cow | VH4-34 CD3 IL8_CDR1-Cow_CDR 2-Human | 132-07 | caggtgcagctacagcagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc | 867 | QVQLQQWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS | 794 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 35 | VH4-34 IL-8 CDR1cow CDR2cow | VH4-34 CD3 IL8_CDR1-Cow_CDR 2-Cow | 132-09 | caggtgcagctacagcagtgggggcgcaggactgttgaagccttcgg agacgctgtccctcacttgcacgcaagcgggtttcactgagcgac aaggcagtgggatggattcgccagcccaggaacacaggggctga gtggctgggcagcatcgatacgcggaacacaggtacaaac cgtccccaagagtcgagtcaccatatcagtagacacggtacctt ccagttctccctgaagctgagctgtgcaccaggaaatacaagacggctg tgtattactgtaccctgtgcaccaggaaactaagaactgagac ccaaggagtgctaaaagacttcagtgtcagtgagtagatcta ccaaaccttcacccaaagctgccaaacaagagattattgtaaagctctgat agtggaccacactgcgcctggaagggctgagaactcaggcagcggt ggtcgtggagaagttcttgaagaggctcatgtggatgtctgggacaggc tctgtattactgtccatgcctggatgtggacaagtgtctgcctagtgctagc | 868 | QVQLQQWGAGLLKPSETLS LTCTASGFSLSDKAVGWIR QPPGKGLEWLGSIDTGGNT GYNPSLKSRVTISVDTSKNQ FSLKLSSVTAADTAVYYCTS VHQETKKYQSPRSAKELRC QCIKTYSKPFHPKFIKELRVI ESGPHCANTEIIVKLSDGRE LCLDPKENWVQRVVEKFLK RAENSGSGSYTYNYEWHV DVWGQGLLVTVSSAS | 798 |
| 36 | VH4-34 MutB IL-8 CDR1cow CDR2cow | VH4-34 CD3 IL8_CDR1-Cow_CDR 2-Cow | 132-09 | caggtgcagctacagcagtgggggcgcaggactgttgaagccttcgg agacgctgtccctcacttgcacgcaagcgggtttcactgagcgac aaggcagtgggatggattcgccagcccaggaacacaggggctga gtggctgggcagcatcgatacgcggaacacaggtacaaac cgtccccaagagtcgagtcaccatatcagtagacacggtacctt ccagttctccctgaagctgagctgtgcaccaggaaatacaagacggctg tgtattactgtaccctgtgcaccaggaaactaagaactgagac ccaaggagtgctaaaagacttcagtgtcagtgagtagatcta ccaaaccttcacccaaagctgccaaacaagagattattgtaaagctctgat agtggaccacactgcgcctggaagggctgagaactcaggcagcggt ggtcgtggagaagttcttgaagaggctcatgtggatgtctgggacaggc tctgtattactgtccatgcctggatgtggacaagtgtctgcctagtgctagc | 869 | QVQLQQWGAGLLKPSETLS LTCTASGFSLSDKAVGWIR QPPGKGLEWLGSIDTGGNT GYNPSLKSRVTISVDTSKNQ FSLKLSSVTAADTAVYYCTS VHQETKKYQSPRSAKELRC QCIKTYSKPFHPKFIKELRVI ESGPHCANTEIIVKLSDGRE LCLDPKENWVQRVVEKFLK RAENSGSGSYTYNYEWHV DVWGQGLLVTVSSAS | 798 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 37 | VH4-34 MutC IL-8 31D32K50 S | VH4-34 CD3 IL8_CDR1-G31DY32K _CDR2-_E50S | 132-05 | caggtgcagctacagcagtggggcgcaggactgttgaagccttcgg agacgctgtccctcacctgcgctgtctatggtggtggtctccagtgaca agtactggagctggattcgccagcccccagggaaggggctggagt ggattgggagcatcaatcatagtggtgaagcaccaactacaaccgtc cctcaagagtcgagtcgagctgtgtgaccgcgcggacacggctgtgt gttctcctgaaggtgagctgagcatcagagagatcatagacatcct attactgtaccctctgtgcaccaggaaaactaagagtcgtcagcat aaggagtgctaaagaactagatgtcagtgcatagagatcatagacatcctc aaaccttccaccactgcgccaaccagaagttcatcaaggagctgagagtgattgagag tggaccacactgcgcctgaaagaggctgagaactcaggcagcagggttct tataactacaattatgaatgtcatgtgatgtctgggacaggccctg ctggtgacagtctctagtgctagc | 870 | QVQLQQWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSPRSAKELRC QCIKTYSKPFHPKFIKELRVI ESGPHCANTEIIVKLSDGRE LCLDPKENWVQRVVEKFLK RAENSGSGSYTYNYEWHV DVWGQGLLVTVSSAS | 800 |
| 38 | VH4-34 MutE IL-8 5R6E31D3 2K50S | VH4-34 CD3 IL8 Q5RQ6E_ CDR1-G31DY32K _CDR2-_E50S | 132-13 | caggtgcagctaagagagagtggggcgcaggactgttgaagccttcg gagacgctgtccctcacctgcgctgtctatggtggtggtctccagtgac aagtactggagctggattcgccagcccccagggaaggggctggag tggattgggagcatcaatcatagtggtgaagcaccaactacaaccgt ccctcaagagtcgagtcgagctgtgtgaccatatcagtagacacggctgtg agtctccctgaaggtcgagctctgtgcaccaggaaactaagagtcgtcagcaccagc tattactgtacctgtgcaccaggaaactagatgtcagtcataaagacatactc aaggagtgctaaagaactagatgtcagtcagtcatagtagacatactc aaaccttccaccactgcgccaaccagaagttcatcaaggagctgagagtgattgagag tggagagaagctgcctgaaagaggctgagaactcaggcagcagggttct tataactacaattatgaatgtcatgtgatgtctgggacaggccctg ctggtgacagtctctagt | 493 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSPRSAKELRC QCIKTYSKPFHPKFIKELRVI ESGPHCANTEIIVKLSDGRE LCLDPKENWVQRVVEKFLK RAENSGSGSYTYNYEWHV DVWGQGLLVTVSS | 787 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 39 | VH4-34 MutD IL-8 CDR1cow CDR2cow | VH4-34 CD3 IL8_CDR1-Cow_CDR2-Cow | 132-09 | caggtcagcagctacagcagtggggcgcaggactgttgaagcctcgg agacgctgtccctcacctgcacagcaagcgggttcactgagcgac aaggcagtgggatgattcgccagcccccagggaagggcctga gtggctggcagcatcgatacggtcgggaacacagggtacaacc cgtccctcaagagtcgagtcaccatatcagtagacacgtccaagaa ccagttctccctgaagctgagctgagtgtgtgaccgccgagacggctg tgtattactgccctctgtgcaccaggaaactaagaacgcagagc ccaaggagtctaaagaactagatgtcagttcatcataagacatact ccaaaccttcaccccaagttcatcaagagctgagagctgattgag agtgaccacactgcgccaaacagagatttattgtaagacttctgat gggaggaacgtctgctgaccccaaggaaaactggtcagcagcggt ggtgtgagaagttctgaagaggctgagaactcaggcagcggt tctatacctacaattatgaatgggcatgtgaggcatggggacaggc ctgctgtgacagtctcagtgctagc | 871 | QVQLQQWGAGLLKPSETLS LTCTASGFSLSDKAVGWIR QPPGKGLEWLGSIDTGGNT GYNPSLKSRVTISVDTSKNQ FSLKLSSVTAADTAVYYCTS VHQETKKYQSPRSAKELRC QCIKTYSKPFHPKFIKELRVI ESGPHCANTEIIVKLSDGRE LCLDPKENWVQRVVEKFLK RAENSGSGSYTYNYEWHV DVWGQGLLVTVSSAS | 798 |
| 42 | BLV1H12 | BLV1H12 HC CowV. Human CH1-2-3 (107) | 131-74 | caggtccagctgagagagagcgccctcactgctgtcaagccatccc agacactgagcctgacactgggcacagcaagcggttcactgagcga caaggcagtgggtagcatggtccgacaaggcaccaggaaaagccctgg aatgctggcagcatcgatacggcggaacacagggtacaaatc ccgactgaagagcagactgtccattaccaagacaactctaaaa gtcaggtgtcactatgtgctgagctgtcaccacagaggatagtgc aactactattgcactctgtcaccaggaaaatgtgattataccaga gctgcctgacgctatcggagagtcgattgcagtaggcca gctgtggcacatccctgctgtgcgtgtcctctatacctacaattatggaactgcc tgactacctgctgggacaggcctgtgactgactctagtgctag c | 872 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSCPDGYRERS DCSNRPACGTSDQCRVSVF GNCLTTLPVSYSYTNYEW HVDVWGQGLLVTVSSAS | 925 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 43 | VH4-34 MutF IL-8 5R6E CD1cow | VH4-34 IL-8 CDR3 Q5RQ6E CDR1-Cow_CDR 2-Human | 132-11 | caggtcagctaagagagtgggcgcaggactgttgaagccttcg gagacgctgtccctcacctgcacagcaagcgggtttcactgagcg acaaggcagtggggattggcagcgccagccccagggaagggctg gagtggattgggagaaatcaatcatagtgaagcaccaactacaac cgtccctcaagagtcgagtcaccatcagtagacacgtccaaga accagttctcctgaagctgagctgtgtaccgccgcgcgacacggct gtgtattactgtacctctgtgccaccaggaaaactaagaaataccagag cccaaggagtgcaaagaactagatgtcagtcagtgagagattga gagtgaccaacactctgcctgaccccaagaaactggtgcag atgggagaagctctgcctgagaagttctgagaactcaggcagc ggttcttatacctacaattatgaatggcatgtgatgtctggggacagg gcctgctggtgacagtctctagt | 494 | QVQLREWGAGLLKPSETLS LTCTASGFSLSDKAVGWIR QPPGKGLEWIGEINHSGST NYNPSLKSRVTISVDTSKNQ FSLKLSSVTAADTAVYYCTS VHQETKKYQSPRSAKELRC QCIKTYSKPFHPKFIKELRVI ESGPHCANTEIIVKLSDGRE LCLDPKENWVQRVVEKFLK RAENSGSGSYTYNYEWHV DVWGQGLLVTVSS | 788 |
| 44 | BLV1H12-IL8 | BLV1H12 HC CowV, CDR3 IL-8, Human CH1-2-3 (105) | 131-76 | caggtccagtgcagagagagcgccctcactgtcaagccatccc agacactgagcctgacatgtcgacacagcaaggcggtttcactgagcga caaggcagtgagtgggtccgacaggcaccaggaaaagccctgg aatggctgggcagcatcgatacccgggaacacaggtacaatc cggactgaagagcagactgtccattaccaaggacaactctaaaa gtcaggtcactgagctgagctgagcgtgactccgtcaccagaggatgtc aactactattgttacctctgtccaggaaactaagaatacagaga gccaaggagtgcaaagaactagatgtcagtcagtgagagttgattg ctccaaaccttccaccccaagttcatcaaggagctgagagtggtgca gagtggagagctctgcctgaccccaagaaaactggtgca gagggtcttggagaagttcttgaagagggctgaaactcaggcag cggttctatacctacaattatgaatgcatgtgatgtctgggggacag ggcctgctggtgacagtctctagtgctagc | 873 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSPRSAKELRC QCIKTYSKPFHPKFIKELRVI ESGPHCANTEIIVKLSDGRE LCLDPKENWVQRVVEKFLK RAENSGSGSYTYNYEWHV DVWGQGLLVTVSSAS | 926 |

Figure 21 (continued)

| BIDs | IgG Name | Heavy Chain Name | VH DNA Sequence | SEQ ID NO: (VH DNA) | VH Amino Acid Sequence | SEQ ID NO: (VH aa) |
|---|---|---|---|---|---|---|
| 45 | BLV1H12 HC CowV, CDR3 IL-8, 1xG4S | BLV1H12 CowV 1xGGGGS linker- IL-8 - HumanCH 123 | caggtccagctgagagagagcggccccttcactgtcaagccatccc agacactgagcctgacatggtcacagcaaggcgggtttcactgagcga caaggcagtgggatggtccgacaggcaccaggaaaagccctgg aatggctgggcagcatcgatacggcgggaacacaggtacaatc ccggactgaagagcagactgtccattaccaaggacaactctaaaa gtcaggtgtcactgagcgtgagctcgtcaccagaggatagtgc aacttactattgcacctgtgccaggaaactaagaaatccaga gcggtggaggagttctgaggaccaaggagtgctaaagaactta gatgtcagtcgataaagacatactccaaacctttccaccccaagtc atcaaggagctgagagtgattgagagtctgggagagctgcctgac acagagattattgtaaagcttctgatggcgagaggtgtggacaggttgtggagaagttcttaag aggctgagaactggggtgtctggggacaggtcgttgggacctctc gaatgcatgtgatgtctggggacaggtcgttgatgcatgtggacagtctc tagtgctagc | 874 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGGSGGP RSAKELRCQCIKTYSKPFHP KFIKELRVIESGPHCANTEIIV KLSDGRELCLDPKENWQR VVEKFLKRAENSGGGSSY TYNYEWHVDVWGQLLVT VSSAS | 927 |
| 46 | BLV1H12 HC CowV, CDR3 IL-8, 3xG4S | BLV1H12 CowV 3xGGGGS linker- IL-8 - HumanCH 123 | caggtccagctgagagagagcggccccttcactgtcaagccatccc agacactgagcctgacatggtcacagcaaggcgggtttcactgagcga caaggcagtgggatggtccgacaggcaccaggaaaagccctgg aatggctgggcagcatcgatacggcgggaacacaggtacaatc ccggactgaagagcagactgtccattaccaaggacaactctaaaa gtcaggtgtcactgagcgtgagctcgtcaccagaggatagtgc aacttactattgcacctgtgccaggaaactaagaaatccaga gcggtggaggaggttctgaggccgggaaagtggtgcgaggta gcggaggaccaaggagtgctaaagaacttagatgcagtcagtaa agacatactccaaacctttccaccacactgccgccaacacagagctgag agtgattgatttctgatggagagctctgcctgaagttcttgaagaggctgagaactc aaggaggtgtgagaaggtgttgaggaggcagtgaggtgtggcag ctctatacctacaattatgaatgcatgtggagtctggggacaggg cctgtcgtgacagtctctagtgctagc | 875 | QVQLRESGPSLVKPSQTLS LTCTASGFSLSDKAVGWVR QAPGKALEWLGSIDTGGNT GYNPGLKSRLSITKDNSKSQ VSLSVSSVTTEDSATYYCTS VHQETKKYQSGGGGSGG GSGGGGSGGPRSAKELRC QCIKTYSKPFHPKFIKELRVI ESGPHCANTEIIVKLSDGRE LCLDPKENWQRVVEKFLK RAENSGGGSGGGGSGG GGSSYTYNYEWHVDVWGQ GLLVTVSSAS | 928 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 47 | VH4-34 MutE 3xG4S IL-8 | VH4-34 Q5RQ6E, G31DY32K, E50S, 3xG4S, IL-8 | 132-37 | caggtgcagctaagagagtggggcgaggactgttgaagccttcg gagacgctgtccctcacctgcgctgtctatgtggtcttcagtgac aagtactggagctggattcgccagcccccagggaaggggctgag tggattggagcatcaatcatagtggaagcaccaactacaaccgt ccctcaagagtcgagtcaccatatcagtagacacgtccaagaacc agtctcctgaagctgagctctgtgaccgccgtgacacggctgtg tattactgtacctctgtcacccaggaaactcagtagtcagatcca ggggacgagg ttctg gaggcggtggagacgagcgagg gagaccaaagagtgctaaagaactagatgtcagtgcataaagac atactccaaactttccaccacactgcgccaacacagagctcagga ttgagagtggagagagctcgtcctgacccccaagagggctgagag agagggtcgtggaggcagtggaggttgatctgatgtctggggacaggg ggtgacagtctcagtgctagc | 876 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGGGSGGPRSAKELRC QCIKTYSKPFHPKFIKELRVI ESGPHCANTEIIVKLSDGRE LCLDPKENWVQRVVEKFLK RAENSGGGSGGGGSGG GGSSYTYNYEWHVDVWGQ GLLVTVSSAS | 929 |
| 48, 68, 72, 75, 80, 94, 100, 101, 111, 115, 1 20, 123, 135 | VH4-34 MutE 3xG4S ShK | VH4-34 Q5RQ6E, G31DY32K, E50S, 3xG4S, ShK | 132-35 | caggtgcagctaagagagtggggcgaggactgttgaagccttcg gagacgctgtccctcacctgcgctgtctatgtggtcttcagtgac aagtactggagctggattcgccagcccccagggaaggggctgag tggattggagcatcaatcatagtggaagcaccaactacaaccgt ccctcaagagtcgagtcaccatatcagtagacacgtccaagaacc agtctcctgaagctgagctctgtgaccgccgtgacacggctgtg tattactgtacctctgtcacccaggaaactcagtagtcagatcca ggggacgagg ttctggaggcggtggagacgagcgagg tgaggaggagctgcatcgacacagcatccccaagacaggctgcag ccttcagtgcaagacctgcgcaccggtgggtgatctggtgaggagg cagtgcggggacagggctgcgctgtgacagtctcagtgctagc | 877 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGGGSGGRSCIDTIPKS RCTAFQCKHSMKYRLSFCR KTCGTCGGGSGGGSGG GGSSYTYNYEWHVDVWGQ GLLVTVSSAS | 930 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 49 | VH4-34 MutE 3xGGS MOKA | VH4-34 Q5RQ6E, G31DY32K, E50S, 3:3GGS, MOKA | 132-36 | caggtgcagctaagagagtggggcgcaggactgttgaagccttcg gagacgctgtccctcacctgcgctgtctatggttgtggtccttcagtgac aagtactgaagtggattcgcagccccaggaagggctggag tggattgggagcatcaatcatagtggaagcaccaactacaaccgt ccctcaagagtcgagtcaccatatcagtagacacgtccaagaacc agttctccctgaagctgagctctgtgaccgccgcggacacgctgtg tattactgtacctctgtcaccaggaaactaaagaaataccagcgg aggaagcggaggaagcggcatcaactgaagtgc agcctgccccagtgcatcaagaaccctgcaagagccggcatg agattcgcaagtgcatgaacaagaagtcagatgctacagcgga ggaagcggaggaagcggaggaagctcttatacctacaattatgaat ggcaatgtggatgtgggacaggcctgctggtgacagtctctagt gctagc | 878 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGSGSGG SGINVKCSLPQQCIKPCKDA GMRFGKCMNKKCRCYSGG SGGSGGSSYTYNYEWHVD VWGQGLLVTVSSAS | 931 |
| 50 | VH4-34 MutF 3xG4S ShK | VH4-34 Q5RQ6E, CDR1 Cow, 3xG4S, ShK | 132-38 | caggtgcagctaagagagtggggcgcaggactgttgaagccctcg gagacgctgtccctcacctgcacagcaagcggttttcactgagcg acaaggcagtggatgatcgcacagccagccccaagaagggctg gagtgattgggaaatcaatcatagtggaagcaccaactacaac cgtcccaagagtcgagtcaccatcagtagacacgtccaaga accagttctccctgaagctgagctctgtgaccgccgcggacacggct gtgtattactgtacctctgtccaccaggaaactaaagaaataccagag cggtggaggttctggaggttctggaggttggcggagtag cggaggaaggagctgcatgacacaagcagaagccgatgca ccgcttccagtcaagcacacgaagaagtacaggctgagctctg caggaagaacctggcacctgcagggttggatcggtgagg agcagtgaggttctgggaggttgtgtcagcaggctcttatacctacaattatgaatgc atgggatctggggacaggcctgctggtgacagtctctagtgcta gc | 879 | QVQLREWGAGLLKPSETLS LTCTASGFSLSDKAVGWIR QPPGKGLEWIGEINHSGST NYNPSLKSRVTISVDTAAYYCTS VHQETKKYQSGGGGSGG GSGGGGSGGRSCIDTIPKS RCTAFQCKHSMKYRLSFCR KTCGTCGGGSGGGGSGG GGSSYTYNYEWHVDVWGQ GLLVTVSSAS | 932 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 51 | VH4-34 MutF 3xG4S IL-8 | VH4-34 Q5RQ6E, CDR1 Cow, 3xG4S, IL-8 | 132-40 | caggtgcagctaagagagtggggcgcaggactgttgaagccttcg gagacgctgtccctcacctgcacgcagcaagcgggtttcactgagcg acaaggcagtggattgccagccagccccaggaagggctg gagtggattggggaaatcaatcatagtggaagcaccaactacaac cgtccccaagagtgcgagtcgagctgtgaccgcgccgacaccggct gtgtattactgtacctgtgaccgggaaaataccagaga cggtgagaggttctggaggcggtggaagtgtggcggagtag cggaggaccaaggagttgctaaagaactagatgcagtcataagag gacatactccaaactccacccagctgcccacacagactgactgaga gtgattctgaggagagctctgttgaaagctggaagagctgagattgaa agcttctgatggagagtgctgtgagaagtgctgagccagtgagccagc ggtgcagagggtgtgatctgtgaggaggcagtggaggtggtgcagc tctatacctacaattatgaatggcatggagtctgggacaggg ctgctggtgacagtctctagtgctagc | 880 | QVQLREWGAGLLKPSETLS LTCTASGFSLSDKAVGWIR QPPGKGLEWIGEINHSGST NYNPSLKSRVTISVDTSKNQ FSLKLSSVTAADTAVYYCTS VHQETKKYQSGGGGSGGG GSGGGGSGGPRSAKELRC QCIKTYSKPFHPKFIKELRVI ESGPHCANTEIIVKLSDGRE LCLDPKENWVQRVVEKFLK RAENSGGGSGGGGSGG GGSSYTYNYEWHVDVWGQ GLLVTVSSAS | 933 |
| 52 | VH4-34 MutF 3xGGS MOKA | VH4-34 Q5RQ6E, CDR1 Cow, 3:3GGS, MOKA | 132-39 | caggtgcagctaagagagtggggcgcaggactgttgaagccttcg gagacgctgtccctcacctgcacgcagcaagcgggtttcactgagcg acaaggcagtggattgccagccagccccaggaagggctg gagtggattggggaaatcaatcatagtggaagcaccaactacaac cgtccccaagagtgcgagtcgagctgtgaccgcgccgacaccggct gtgtattactgtacctgtgaccgggaaaataccagaga cggaggaagaagtggaggaagcccctgcaggaccgtgaa gtgcagcctgcccagtcggcatgaacaagagtgcaatgcgtacag cggaggaagcggagaagctgctttatacctactacaattac tgaatgcatgtgatctgtggggacagggcctgctgtgacagtct ctagtgctagc | 881 | QVQLREWGAGLLKPSETLS LTCTASGFSLSDKAVGWIR QPPGKGLEWIGEINHSGST NYNPSLKSRVTISVDTSKNQ FSLKLSSVTAADTAVYYCTS VHQETKKYQSGGSGGSGG SGINVKCSLPQQCIKPCKDA GMRFGKCMNKKCRCYSGG SGSGGSSYTYNYEWHVD VWGQGLLVTVSSAS | 934 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 53, 155 | VH4-34 MutE 3xG4S ProTxII | VH4-34 Q5RQ6E, G31DY32K, E50S, 3xG4S, ProTxII | 132-31 | caggtgcagctaagagagtggggcgcaggactgttgaagccttcg gagacgctgtccctcacctgcgctgtctatgtggtcctcagtgac aagtactggagctggattcgccagcccccaggaagggctggag tggattggagcatcaatcatagtggaagcaccaactacaaccgt ccctcaagagtcgagtcaccatatcagtagacacgtccaagaacc agtctctccctgaagctgagctctgtgaccgccgcggacacggctgtg tattactgtacctctgtgccaccaggaaaataccagagcgg tggaggaggttctgagggcggtgaaggtggtggcgacagcgg aggaactgccagaaagtgcatggtgatggacctgcagcagtgagaga agtgctcgagggcatggtgtgcaggctgtggtgagagagagaagct gtggggagttgtgatctggtggaggagcagtggaggtgggaca cagctcttataccactaaatgcacagtctagtgctagc | 882 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGGSGGG GSGGGGSGGYCQKWMWT CDSERKCCEGMVCRLWCK KKLWGGGSGGGGSGGG GSSYTYNYEWHVDVWGQG LLVTVSSAS | 935 |
| 54, 78, 156 | VH4-34 MutE 3xG4S GPTX1 | VH4-34 Q5RQ6E, G31DY32K, E50S, 3xG4S, GPTX1 | 132-34 | caggtgcagctaagagagtggggcgcaggactgttgaagccttcg gagacgctgtccctcacctgcgctgtctatgtggtcctcagtgac aagtactggagctggattcgccagcccccaggaagggctggag tggattggagcatcaatcatagtggaagcaccaactacaaccgt ccctcaagagtcgagtcaccatatcagtagacacgtccaagaacc agtctctccctgaagctgagctctgtgaccgccgcggacacggctgtg tattactgtacctctgtgccaccaggaaaataccagagcgg tggaggaggttctgagggcggtggaagtggtgcggtagcgg aggaactgctgggcttcatgaggagtcatcccgacaacga caagtctgcaggccaacctgtgtgcagcaggaccacaagtg gtgcaagtacgtgttcggagggtgtgaatcggtggaggaggcagt ggaggtggttgcagcacgggctgcttaacctacaattaagatggcatgtggat gtctggggacaggccctgcctgtgacagtctcagtgctagc | 883 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGGSGGG GSGGGGSGGDCLGFMRKC IPDNDKCCRPNLVCSRTHK WCKYVFGGGSGGGGSG GGSSYTYNYEWHVDVWG QGLLVTVSSAS | 936 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 55, 64, 102, 110, 112, 121, 125, 160, 163, 166, 169 | VH4-34 MutE No Knob | VH4-34 Q5RQ6E, G31DY32K, E50S, CDR3 CowStalks-3xGGS | 132-49 | caggtcagctaagagagtggggcgcaggactgttgaagccttcg gagacgctgtcccctcacctgcgctgtctatggtgtggtccttcagtgac aagtactggagctggattcgccagccccagggaaggggctgag tggattgggagcatcaatcatagtggaagtaccaactacaacccgt ccctcaagagtcgagtcaccatatcagtagacacgtccaagaacc agttctccctgaagctgagctctgtgaccgccgcggacacgctgtg tattactgtacctctgtgcaccaggaaaataccagagcgg aggaagcggaggaagcggaggaagctcttatactacaattatga atggcatgtgtctggggtctggggacagggcctgctggtgacagtctcta gtgctagc | 884 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGSGSGG SSYTYNYEWHVDVWGQGL LVTVSSAS | 937 |
| 56, 124, 145, 146, 147, 148 | VH4-34 MutE 1xG4S ShK | VH4-34 Q5RQ6E, G31DY32K, E50S, CDR3 CowStalks-1xG4S ShK | 132-53 | caggtcagctaagagagtggggcgcaggactgttgaagccttcg gagacgctgtcccctcacctgcgctgtctatggtgtggtccttcagtgac aagtactggagctggattcgccagccccagggaaggggctgag tggattgggagcatcaatcatagtggaagtaccaactacaacccgt ccctcaagagtcgagtcaccatatcagtagacacgtccaagaacc agttctccctgaagctgagctctgtgaccgccgcggacacgctgtg tattactgtacctctgtgcaccaggaaaataccagagcgg tgagagaggttctggaggaaggagctgcatcgacacagcatcccaa gagccgatgcttctgcaggaagacctgcggcaccctgcgcgaggtgtgga tcttctataacctacaattatgaatgcatgtgatgtctggggacagg gcctgctggtgacagtctctagtgctagc | 885 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGGSGGR SCIDTIPKSRCTAFQCKHSM KYRLSFCRKTCGTCGGGGS SYTYNYEWHVDVWGQGLL VTVSSAS | 938 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 57 | VH4-34 MutE ShK-16K 1xG4S | VH4-34 Q5RQ6E, G31DY32K, E50S, CDR3 CowStalks-1xG4S ShK-16K | 132-52 | caggtgcagctaagagagtggggcgcaggactgttgaagccttcg gagacgctgtcctccacctgcgctgtctatggtggtggtcttcagtgac aagtactggagctggattcgccagcccccaggaaggggctggag tggattgggagcatcaatcatagtggaagcaccaactacaacccgt cccctcaagagtcgagtcactatcagtagacacgtccaagaacc agttctccctgaagctgagctgtgtcaccagaaactaagaacaccgg tattactgtaccctgtgcaccaggaaggagctgcatcgacaacagagcgg tggaggaggttctgaggaaggagctcaagtgcaacagcatgaagtacag gagccgatgcacccgccttcaagtgcaaagacctgcggcaccctgcggagcggttggaca gctgagcttctacctataccaattatgaatgtctagtgctcagcctagc tctcttatactgacagtctctagtgac gcctgctggtgacagtctctagtgctagc | 886 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGR SCIDTIPKSRCTAFKCKHSM KYRLSFCRKTCGTCGGGGS SYTYNYEWHVDVWGQGLL VTVSSAS | 939 |
| 58 | MutE ShK-16K 3xG4S | VH4-34 Q5RQ6E, G31DY32K, E50S, CDR3 CowStalks-3xG4S ShK-16K | 132-56 | caggtgcagctaagagagtggggcgcaggactgttgaagccttcg gagacgctgtcctccacctgcgctgtctatggtggtggtcttcagtgac aagtactggagctggattcgccagcccccaggaaggggctggag tggattgggagcatcaatcatagtggaagcaccaactacaacccgt cccctcaagagtcgagtcactatcagtagacacgtccaagaacc agttctccctgaagctgagctgtgtcaccagaaactaagaacaccgg tattactgtaccctgtgcaccaggaaactaagaacaggctgtg tgaggaggttctgaggcggtgaagtggtgcgtgaggtagccg aggaaggagctcatcgacacagcgaagtacccaagagcgatgcaacg cctcaagtgcgcaccctgcggaggtggtggatctggtgggtggaggag cagtggaggtgtgggaccaggggcctgcttataccactacaattatgaatggcatgt ggatgtctggggaccagggccctgctggtgacagtctctagtgctagc | 887 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGGSGG GSGGGGSGGRSCIDTIPKS RCTAFKCKHSMKYRLSFCR KTCGTCGGGGSGGGGSGG GGSSYTYNYEWHVDVWGQ GLLVTVSSAS | 940 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 59, 137, 144, 149, 153, 159, 161, 162, 164, 165, 167, 168, 170, 171, 172, 173, 175, 176, 177, 178, 179 | VH4-34 MutE Shk-No Linker | VH4-34 Q5RQ6E, G31DY32K, E50S, CDR3 Shk-No Linker | 132-61 | caggtgcagctaagagagtggggcgcaggactgttgaagccttcg gagacgctgtccctcacctgcgctgtcatgtgtggtccttcagtgac aagtactggagctggattcgccagcccccagggaagggctggag tggattgggagcatcaatcatagtgaagtcaccaactacaacccgt ccctcaagagtcgagtcaccatcagtagacacgtccaagaacc agttctcctgaagctgagctctgtgaccgccgcggacacggctgtg tattactgtacctctgtcaccagaaactaagcacccgcctcca gagctgcatgacacagcatgaagtacaggctgcttctgcaggaagac gtgcggcaccgctctatactacaattatgaatgcatggatgtct ggggacagggcctgtggtgacagtctagtgctagc | 888 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSRSCIDTIPKS RCTAFQCKHSMKYRLSFCR KTCGTCSYTYNYEWHVDV WGQGLLVTSSAS | 941 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 60, 69, 73, 76, 138 | VH4-34 MutE G-ShK-G | VH4-34 Q5RQ6E, G31DY32K, E50S, CDR3 G-ShK-G | 132-62 | caggtcagctaagagagtggggcgcaggactgttgaagccttcg gagacgctgtccctcacctgcgctgtctatggtgtgggtccttcagtgac aagtactggagctggattcgccagcccccagggaaggggctggag tggattgggagcatcaatcatagtggaagcaccaactacaaccgt ccctcaagatgcgagtcaccatatcagtagacacgtccaagaacc agttctccctgaagctgagctgtgtcaccgaaaactaagaaatacca gcctgtgtattactgtacctctgtcaccagacaccatgaagcaccagaccccagcaaccagcctgccctcacctataccacaattatgaatgcatgt ggatgtctgtgtggggacagggcctgtggtgacagtctcagtgctagc | 889 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGRSCIDTIPK SRCTAFQCKHSMKYRLSFC RKTCGTCGSYTYNYEWHVD VWGQGLLVTVSSAS | 942 |
| 61, 139 | VH4-34 MutE GG-ShK-GG | VH4-34 MutE GG-ShK-GG | 132-63 | caggtcagctaagagagtggggcgcaggactgttgaagccttcg gagacgctgtccctcacctgcgctgtctatggtgtgggtccttcagtgac aagtactggagctggattcgccagcccccagggaaggggctggag tggattgggagcatcaatcatagtggaagcaccaactacaaccgt ccctcaagatgcgagtcaccatatcagtagacacgtccaagaacc agttctccctgaagctgagctgtgtcaccgaaaactaagaaatacca gcgggaggagctgcatcgacacagcatgaagtacaggctgagcttctgcag cctccagtgcaagcacagcgcacctgcggaggctctataccacaattatgaat ggcatggatgtctggggggacagggcctgtgggtgacagtctcagtg ctagc | 890 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGRSCIDTIP KSRCTAFQCKHSMKYRLSF CRKTCGTCGGSYTYNYEW HVDVWGQGLLVTVSSAS | 943 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 65, 140 | VH4-34 MutE GSGG-Shk-GGGG | VH4-34 Q5RQ6E, G31DY32K, E50S, CDR3 GSGG-Shk-GGGG | 132-75 | caggtgcagctaagagagtggggcgcaggactgttgaagccttcg gagacgctgtccctcacctgcgctgtctatggtggtcagtgac aagtactgagctgattgccagcccccaggaaggggctgag tggattgggagcatcaatcatagtggaagcaccaactacaaccgt ccctcaagagtcgagtcacctatcagtagacacgtccaagaaacc agttccctgaagctgagctctgtgaccgcgcgggacacggctgtg tattactgtgcctgtgcacgagaaataccagagcgg ttctgaggaagagctgcatgcaagcacacctgggagtgtgagcttc caccgccttccagtgcaagacctgggcaccgcggaggtggacagggccgatg tgcaggaaagaccctggaagccatgaagtacaggctgagcttc caattatgaatgcatgtggatgtctggggacagggcctgtggtga cagtctcagtgctagc | 891 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGSGGRSCID TIPKSRCTAFQCKHSMKYRL SFCRKTCGTCGGGGSYTYN YEWHVDVWGQGLLVTVSS AS | 944 |
| 66, 141 | VH4-34 MutE GGGG-Shk-GGGG | VH4-34 Q5RQ6E, G31DY32K, E50S, CDR3 GGGG-Shk-GGGG | 132-76 | caggtgcagctaagagagtggggcgcaggactgttgaagccctcg gagacgctgtccctcacctgcgctgtctatggtggtcagtgac aagtactgagctgattgccagcccccaggaaggggctgag tggattgggagcatcaatcatagtggaagcaccaactacaaccgt ccctcaagagtcgagtcacctatcagtagacacgtccaagaaacc agttccctgaagctgagctctgtgaccgcgcgggacacggctgtg tattactgtgcctgtgcacgagaaataccagagcgg tggaggaggaggctgcatcgacacagcaagtacaggctgagcttc caccgccttccagtgcaagacctgggcaccgcggaggtggacagggccgatg tgcaggaaagaccctggaagccatgaagtacaggctgagcttc caattatgaatgcatgtggatgtctggggacagggcctgtggtga cagtctcagtgctagc | 892 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGGRSCID TIPKSRCTAFQCKHSMKYRL SFCRKTCGTCGGGGSYTYN YEWHVDVWGQGLLVTVSS AS | 945 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 67, 70, 74, 77, 142 | VH4-34 MutE GGG-Shk-GGG | VH4-34 Q5RQ6E, G31DY32K, E50S, CDR3 GGG-Shk-GGG | 132-77 | caggtgcagctaagagagtggggcgcaggactgttgaagccttcg gagacgctgtccctcacctgcgctgtctatggtggtccttcagtgac aagtactggagctggattcgccagcccccaggggaagggctgga gtggattgggagcatcaatcatagtggaagcaccaactacaaccgt ccctcaagagtcgagtcaccatatcagtagacacgtccaagaacc agttctccctgacctctgtcaccagaaactaccagaccgactgg tattactgtaccctgtgcaccaggagctgaccgcgggacacggctgtg aggaggagctgcaagcacagacatgaaaataccagaccgca ccgccttccagtgcaagacctgcggtggtgacacctgagctctg caggaaagacctgcggcactgcggtggtgatctatacctacaatt atgaatgggcatgtctgatctgggacagggcctgctgctgacagtc tctagtgctago | 893 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGRSCIDTI PKSRCTAFQCKHSMKYRLS FCRKTCGTCGGGSYTYNYE WHVDVWGQGLLVTVSSAS | 946 |
| 92, 95, 103 | VH4-34 MutE 3xG4S ShK S62G | VH4-34 Q5RQ6E S62G MutE CD1_G31D Y32K_CD2 _E50S_CD 3_3XG4S_Shk | 133-76 | caggtgcagctaagagagtggggcgcaggactgttgaagccttcg gagacgctgtccctcacctgcgctgtctatggtggtccttcagtgac aagtactggagctggattcgccagcccccaggggaagggctgag tggattgggagcatcaatcatagtggaagcaccaactacaaccgg gcctcaagagtcgagtcaccatatcagtagacacgtccaagaacc agtctccctgacctctgtgaccagaaactaccagaccgctgtg tattactgtaccctgtgcaccagaagctgagggtgttggcggaatgcgg tggaggaggttctggaggcggttggaggtgtggcggaggtagcgg aggaggagctgcatcgacacagcagctgaagtagacggccatgcaccg ccttccagtgcaagacctgcggcctgcggtgttgatctggtggaggag cagtggaggtgtgcagctctataacctacaattatgaatggcatgt ggatgtctggggacagggcctgtgtgacagtctagtgctag | 894 | QVQLREWGAGLLKPSETLS LTCAVYGGSFSDKYWSWIR QPPGKGLEWIGSINHSGST NYNPGLKSRVTISVDTSKNQ FSLKLSSVTAADTAVYYCTS VHQETKKYQSGGGGSGGG GSGGGGSGGGRSCIDTIPKS RCTAFQCKHSMKYRLSFCR KTCGTCGGGSGGGGSGG GGSSYTYNYEWHVDVWGQ GLLVTVSSAS | 947 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 104, 113, 119, 122 | VH4-34 MutE 2xG4S ShK | VH4-34 Q5RQ6E MutE_CD1 G31DY32K _CD2_E50 S_CDR3_2 xG4S ShK | 134-12 | caggtgcagctaagagagtggggcgcaggactgttgaagccttcg gagacgctgtccctcacctgcgctgtctatggtggtggttcagtgac aagtactggagctggattcgccagccccagggaagggctgag tggattgggagcatcaatcatagtggaagcaccaactacaaccgt ccctcaagagtcgagtcaccatatcagtagacacgtccaagaacc agttctccctgaagctgagctctgtgaccgccgcggacacggctgtg tattactgtacctctgtgcaccaggaaaataccagagcgg aggcggtggaagttggtgcggaagtagcgagggaagtagcgg atcgacacccaagagcctgagctctcaggaagtgtggcagctgcaag cacagcatgaagtacaggctgagctctcaggaagacctgctctata cct acctgcggggaacctgtagcttcggcaagacctgccttcgtctacagaagacctgctgtg acagtctctagtgctagc | 895 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGRSCIDTIPKSRCTAFQ CKHSMKYRLSFCRKTCGTC GGGSGGGSSYTYNYEW HVDVWGQGLLVTVSSAS | 948 |
| 105 | VH4-34 MutE 3xG4S ShK (M21Q) | VH4-34 Q5RQ6E MutE_CD1 G31DY32K _CD2_E50 S_CDR3_3 xG4S ShK (M21Q) | 134-13 | caggtgcagctaagagagtggggcgcaggactgttgaagccttcg gagacgctgtccctcacctgcgctgtctatggtggtggttcagtgac aagtactggagctggattcgccagccccagggaagggctgag tggattgggagcatcaatcatagtggaagcaccaactacaaccgt ccctcaagagtcgagtcaccatatcagtagacacgtccaagaacc agttctccctgaagctgagctctgtgaccgccgcggacacggctgtg tattactgtacctctgtgcaccaggaaaataccagagcgg tggaggaggttctggaggcggtggaagtggtggcggaggtagcgg aggaaggagctgcatcatgacaccccaagagcctgagctctctcag gagacctgcggagcacctgcgaggtggtttgatctgtgagagg cagtggaggtgtgcagctattacctacaattatgaatggcatgt ggatgtctggggacaggccctgctggtgacagtctctagtgctagc | 896 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGGGSGGRSCIDTIPKS RCTAFQCKHSQKYRLSFCR KTCGTCGGGSGGGSGGG GGSSYTYNYEWHVDVWGQ GLLVTVSSAS | 949 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 106 | VH4-34 MutE 3xG4S ShK (M21L) | VH4-34 Q5RQ6E MutE_CD1 _G31DY32K _CD2_E50 S_CDR3_3 xG4S ShK (M21L) | 134-14 | caggtgcagctaagagagtggggcgcaggactgttgaagccttcg gagacgctgtcctcacctgcgctgtctatggtgtgctttcagtgac aagtactgagctgattcgccagccccaggaagcggaagggctgag tggattgggagcatcaatcatagtgaagcaccaactacaaccgt ccctcaagagtcgagtcagctctgtcaccaatcagtagacacgctcaagaacc agttcctgaagctgagctgtgcacaggaaatacccagagcgg tattactgtactctgtgagggtggcggcggcaggctggcgacgagcagc aggaaggagctgccacacacaccccaagagcaccgatgccatcc cctcagtgcaagcaccgccgaggtggagctggatcggtggaggg cagtgaggtgttggcagctctatactaattatgaatgcatgt ggatgtcggggacaggctgctgctggtgacagtctcagtgctagc | 897 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGGGSGGGRSCIDTIPKS RCTAFQCKHSLKYRLSFCR KTCGTCGGGGSGGGGSGG GGSSYTYNYEWHVDVWGQ GLLVTVSSAS | 950 |
| 107, 114 | VH4-34 MutE 3xG4S ShK (M21F) | VH4-34 Q5RQ6E MutE_CD1 _G31DY32K _CD2_E50 S_CDR3_3 xG4S ShK (M21F) | 134-15 | caggtgcagctaagagagtggggcgcaggactgttgaagccttcg gagacgctgtcctcacctgcgctgtctatggtgtgctttcagtgac aagtactgagctgattcgccagccccaggaagcggaagggctgag tggattgggagcatcaatcatagtgaagcaccaactacaaccgt ccctcaagagtcgagtcagctctgtcaccaatcagtagacacgctcaagaacc agttcctgaagctgagctgtgcacaggaaatacccagagcgg tattactgtactctgtgagggtggcggcggcaggctggcgacgagcagc ccttcagtgcaagcaccgccgaggtggagctgggatcggtggaggg aagaccgcggcaccgccaggtggagctggatcggtggaggg agtgaggtgtggcagcttatactacctaattatgaatgcatgt gatgtctggggacaggctgctgctggtgacagtctcagtgctagc | 898 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGGGSGGGRSCIDTIPKS RCTAFQCKHSFKYRLSFCR KTCGTCGGGGSGGGGSGG GGSSYTYNYEWHVDVWGQ GLLVTVSSAS | 951 |

Figure 21 (continued)

| BiDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 108 | VH4-34 MutE 3xG4S ShK (M21) | VH4-34 Q5RQ6E MutE_CD1_G31DY32K_CD2_E50S_CDR3_3 xG4S ShK (M21) | 134-16 | caggtgcagctaagagagagtggggcgcaggactgttgaagccttcg gagacgctgtccctcacctgcgctgtctatggtggttcttcagtgac aagtactggagctggattgccagcccaggaaggggctggag tggattgggagcatcaatcatagtggaagcaccaactacaacccgt ccctcaagagtcgagtcaccatatcagtagacacgtccaagaacc agtctcctgaagctgagctctgtcaccaggaaactaagaatccagagcgg tattactgtacctctgtcaccaggaaactaagaatccagagcgg tggaggaggttctggagcggttgaaggtggtgcggaggtagcgg aggaaggagctgcatgcacacagcacccaagacaggcgatgcaccg cctccagtgcaggctgtgcaggtggatcggatcggtggatggaggatggaggctctcagtctgcaggggacagggctgttcctataccacagtaatgcatgt ggatgtctgggacagggctggtgacagtctcagtgctagc | 899 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGGSGGRSCIDTIPKS RCTAFQCKHSIKYRLSFCRK TCGTCGGGSGGGSGGGG GSSYTYNYEWHVDVWGQG LLVTVSSAS | 952 |
| 109 | VH4-34 MutE 3xG4S ShK (M21A) | VH4-34 Q5RQ6E MutE_CD1_G31DY32K_CD2_E50S_CDR3_3 xG4S ShK (M21A) | 134-17 | caggtgcagctaagagagagtggggcgcaggactgttgaagccttcg gagacgctgtccctcacctgcgctgtctatggtggttcttcagtgac aagtactggagctggattgccagcccaggaaggggctggag tggattgggagcatcaatcatagtggaagcaccaactacaacccgt ccctcaagagtcgagtcaccatatcagtgtgaccgcggacacgtccaagaacc agtctcctgaagctgagctctgtcaccaggaaactaagaatccagagcgg tattactgtacctctgtcaccaggaaactaagaatccagagcgg tggaggaggttctggagcggttgaaggtggtgcggaggtagcgg aggaaggagctgcatgcaagcacagcacccaagtacaggcgatgcaccg cctccagtgcaggctgtgcaggtggatcggatcggtggatggaggatggaggctctcagtctgcaggggacagggctgttcctataccacagtaatgcatgt ggatgtctgggacagggctggtgacagtctcagtgctagc | 900 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGG GSGGGSGGRSCIDTIPKS RCTAFQCKHSAKYRLSFCR KTCGTCGGGSGGGGSGG GGSSYTYNYEWHVDVWGQ GLLVTVSSAS | 953 |

Figure 21 (continued)

| BIDs | IgG Name | Heavy Chain Name | Heavy Chain Plasmid # | VH DNA Sequence | SEQ ID NO: (VH DNA) | VH Amino Acid Sequence | SEQ ID NO: (VH aa) |
|---|---|---|---|---|---|---|---|
| 157 | VH4-34MutE 1xG4S ProTxII | VH4-34 Q5RQ6E, G31DY32K, E50S, CDR3 CowStalks-1xG4S ProTxII | 132-54 | caggtgcagctaagagagtggggcaggactgttgaagccttcg gagacgctgtccctcacctgcgctgtctatggtgcttcagtgac aagtactggagctggattgccagcccagggaagggctggag tggattgggagcatcaatcatagtgtgaagcaccaactacaaccgt ccctcaagagtcgagtcaccatatcagtagacacgtccaagaacc agttctccctgaagctgagctctgtgaccgccgacacggctgtg tattactgtacctctgtgcaccaggaaactaagaaataccagagcgg tgaggaggttctgagaggaagtgctgcgaggggcatgtgtgcaggctgtg gacagcgagaagaagctgtgggaggtggtgatcttctatacctacaat tatgaattggcatgtgatgtctggggacagggcctgctgatgacagt ctctagtgctagc | 901 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGY CQKWMWTCDSERKCCEG MVCRLWCKKKLWGGGGSS YTYNYEWHVDVWGQGLLV TVSSAS | 954 |
| 158 | VH4-34MutE 1xG4S GPTX1 | VH4-34 Q5RQ6E, G31DY32K, E50S, CDR3 CowStalks-1xG4S GPTX1 | 132-55 | caggtgcagctaagagagtggggcaggactgttgaagccttcg gagacgctgtccctcacctgcgctgtctatggtgcttcagtgac aagtactggagctggattgccagcccagggaagggctggag tggattgggagcatcaatcatagtgtgaagcaccaactacaaccgt ccctcaagagtcgagtcaccatatcagtagacacgtccaagaacc agttctccctgaagctgagctctgtgaccgccgacacggctgtg tattactgtacctctgtgcaccaggaaactaagaaataccagagcgg tgaggaggttctgagaggaagactgcctggcttcatgaggaagtgc atcccgacaacgacaagtgctgcaagtacgttcggaggtggtgagcagc aggaccacaagttgtcaagtacgttcggagggtggtgatcttc ttatacctacaattatgaatggcatgtgatgtctggggacagggcct gctggtgacagtctcagtgctagc | 902 | QVQLREWGAGLLKPSETLS LTCAVYGGSFSDKYWSWIR QPPGKGLEWIGSINHSGST NYNPSLKSRVTISVDTSKNQ FSLKLSSVTAADTAVYYCTS VHQETKKYQSGGGSGGD CLGFMRKCIPDNDKCCRPN LVCSRTHKWCKYVFGGG SSYTYNYEWHVDVWGQGL LVTVSSAS | 955 |

Figure 22

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 201 | BLV1H12 GGS1:1 ProTxII | BLV1H12 LC CowV HuLamC | 131-73 | caggccgtcctgaaccagccaagcagcgtctccggtctctggggc agcgggtctcaatcacctgagcgggtcttcctcaaatgtgggcaaac ggctacgtgtctgttggtatcagctgcctggcagtgcccacgaacc ctgatctacggcgacacatccagagcttctgggtcccgatcggttc tcagggagcagatccggaaacacagattattctgcgcatcagctccc tgcaggctgaggacgaagcagattattctgcgcatcctgccgaggac tctagttcaaaatgccgtgtttggaaggcggcaccacactgacagtccta ggtcagcccaaggctcaagccaacaaggccacagtgcctgaaggcagagtga actctaccccgtcaaggcgggagtcgggaccaccacacacctccaaacaa gcccgtcaaggcgggagtgcggccagcagtgctacagagctgacgcct agcaacaacaagtacggccagcagaagctacagctgccaggtcacgcat gagcaggtgaagtccacagagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 202 | BLV1H12 GGS1:2 ProTxII | BLV1H12 LC CowV HuLamC | 131-73 | caggccgtcctgaaccagccaagcagcgtctccggtctctggggc agcgggtctcaatcacctgagcgggtcttcctcaaatgtgggcaaac ggctacgtgtctgttggtatcagctgcctggcagtgcccacgaacc ctgatctacggcgacacatccagagcttctgggtcccgatcggttc tcagggagcagatccggaaacacagattattctgcgcatcagctccc tgcaggctgaggacgaagcagattattctgcgcatcctgccgaggac tctagttcaaaatgccgtgtttggaaggcggcaccacactgacagtccta ggtcagcccaaggctcaagccaacaaggccacagtgcctgaaggcagagtga actctaccccgtcaaggcgggagtcgggaccaccacacacctccaaacaa gcccgtcaaggcgggagtgcggccagcagtgctacagagctgacgcct agcaacaacaagtacggccagcagaagctacagctgccaggtcacgcat gagcaggtgaagtccacagagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 203 | BLV1H12 GGS2:1 ProTxII | BLV1H12 LC CowV HuLamC | 131-73 | caggccgtcctgaaccagccaagcagcgtctccggtctgggc agcgggtctcaatcacctgtagcgggtcttcctccaatgtcggcaac ggctacgtgtcttggtatcagctgatcccggcagtgcccacgaacc ctgatctacggcgacacatccagagcttctgggtccccgatcggttc tcaggagcagatccgaaacacagctactctgaccatcagctccc tgcaggctgaggacgaagcagattatttctgcgcatctgccgaggac tctagttcaaatgccgtgttttggaagcggcaccacactgacagtccta ggtcagcccaaggctgcccccctcggtcactcttgtcccctcct gaggagcttcaagccaacaaggccacagtgcctggaaggcagatagca actctacccggagcgggagtggaccaccaccccccaaacaa gccaacaaagtacgcggccagcagcagctactgagcctgacgcct gagcagtggaagtccacagaagctgccagtcacgtcacgcat gaagggagcaccgtggagaagacagtggcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 32, 204 | BLV1H12 GGS1:1 Moka | BLV1H12 LC CowV HuLamC | 131-73 | caggccgtcctgaaccagccaagcagcgtctccggtctgggc agcgggtctcaatcacctgtagcgggtcttcctccaatgtcggcaac ggctacgtgtcttggtatcagctgatcccggcagtgcccacgaacc ctgatctacggcgacacatccagagcttctgggtccccgatcggttc tcaggagcagatccgaaacacagctactctgaccatcagctccc tgcaggctgaggacgaagcagattatttctgcgcatctgccgaggac tctagttcaaatgccgtgttttggaagcggcaccacactgacagtccta ggtcagcccaaggctgcccccctcggtcactcttgtcccctcct gaggagcttcaagccaacaaggccacagtgcctggaaggcagatagca actctacccggagcgggagtggaccaccaccccccaaacaa gccaacaaagtacgcggccagcagcagctactgagcctgacgcct gagcagtggaagtccacagaagctgccagtcacgtcacgcat gaagggagcaccgtggagaagacagtggcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 30, 205, 227 | BLV1H12 GGS1.2 Moka | BLV1H12 LC CowV HuLamC | 131-73 | caggccgtcctgaaccagccaagcagcgtctccggtctctggggc agcgggtcaatcacctgtagcgggtcttcctccaatgtcggcaac ggctacgtgtctgttggtatcagctgtatccctggcagtgcccacgaacc ctgatctacggcgacacatccgagagcttcgggtccccgatcggttc tcaggagcagatccgaaacacagctactctgaccatcagctccc tgcaggctgaggacgaagcagattattctgcgcatctgccgaggac tctagttcaaatgccgtgttttggaagcggcaccacactgacagtcta ggtcagcccaaggctcaagtccaacaaggccacactggtgtctccctct gaggagcttcaccgggagccgtgacagtgcctgaaggcagatagca actctaccccgggagcgtggagtccgccagcagctacgtgactgagcctgacgcct agcaacaacaagtacggccacagaagctacagctgccaggtcacgcat gagggagcaccgtggagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 31, 206 | BLV1H12 GGS2.1 Moka | BLV1H12 LC CowV HuLamC | 131-73 | caggccgtcctgaaccagccaagcagcgtctccggtctctggggc agcgggtcaatcacctgtagcgggtcttcctccaatgtcggcaac ggctacgtgtctgttggtatcagctgtatccctggcagtgcccacgaacc ctgatctacggcgacacatccgagagcttcgggtccccgatcggttc tcaggagcagatccgaaacacagctactctgaccatcagctccc tgcaggctgaggacgaagcagattattctgcgcatctgccgaggac tctagttcaaatgccgtgttttggaagcggcaccacactgacagtcta ggtcagcccaaggctcaagtccaacaaggccacactggtgtctccctct gaggagcttcaccgggagccgtgacagtgcctgaaggcagatagca actctaccccgggagcgtggagtccgccagcagctacgtgactgagcctgacgcct agcaacaacaagtacagtgaagtccacagaagctacagctgccaggtcacgcat gagggagcaccgtggagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 33, 41, 207 | BLV1H12 GGS3:3 Moka | BLV1H12 LC CowV HuLamC | 131-73 | caggccgtcctgaaccagccaagcagcgtctccggtctgggc agcgggtctcaaatcacctgtagcgggtcttcctccaatgtcaac ggctacgtgtcttggtatcagctgatccctggcagtgcccacgaacc ctgatctacggcgacacatccagagcttctgggtccccgatcggttc tcaggagcagatccggaaacacagctactctgaccatcagctccc tgcaggctgaggacgaagcagattattctgcgcatcgccgaggac tctagttcaaatgccgtgtttggaagcggcaccacactgacagtccta ggtcagcccaaggctgcccctcggtcactctgttccgcctctct gaggagcttcaagccacaaggccacactgtgtctcataagtg actctaccccggagcggtgacagtgcctgagaaggcagatagca gccccgtcaaggcgggagtgcggccagcagctacagcgacgcct gagcagtggaagtccacagaagactacagctgccaggtcacgcat gaagggagcaccgtgagaagacagtgcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 208 | BLV1H12 GGS1:1 GG-ProTxII-GG | BLV1H12 LC CowV HuLamC | 131-73 | caggccgtcctgaaccagccaagcagcgtctccggtctgggc agcgggtctcaaatcacctgtagcgggtcttcctccaatgtcaac ggctacgtgtcttggtatcagctgatccctggcagtgcccacgaacc ctgatctacggcgacacatccagagcttctgggtccccgatcggttc tcaggagcagatccggaaacacagctactctgaccatcagctccc tgcaggctgaggacgaagcagattattctgcgcatcgccgaggac tctagttcaaatgccgtgtttggaagcggcaccacactgacagtccta ggtcagcccaaggctgcccctcggtcactctgttccgcctctct

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 209 | BLV1H12 GGS1:2 GG-ProTxII-GG | BLV1H12 LC CowV HuLamC | 131-73 | caggccgtcctgaaccagccaagcagcgtctccggtctctggggcagcgggtctcaatcacctgagcgggtcttcctccaatgtcggcaacggctacgtgtcttggtatcagctgatccctggcagtgccccacgaacctgatctacgcgacacatccggaacacagttctgggtccccgatcggttcaggagcagatccgaaacacagctactctgaccatcagctcctgcaggctgaggacgaagcagattatttctgcgcatctgccgaggactctagttcaaatgccgtgttggaagcggcaccacactgacagtccaggtcagcccaaggctcaactccccgtcactgtttccgccctcctctgaggagcttaagccggagccgtgacagtgcctgaaggcagatagcaacttctaccccggagccgggaggccagaagcgccacccgagcctgagcgcctagcaacaacaagtacgcggccacagaagctacagctgccaggtcacgcatgagggagcaccgtggagaagacagtgccctacacgaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 210 | BLV1H12 GGS2:1 GG-ProTxII-GG | BLV1H12 LC CowV HuLamC | 131-73 | caggccgtcctgaaccagccaagcagcgtctccggtctctggggcagcgggtctcaatcacctgagcgggtcttcctccaatgtcggcaacggctacgtgtcttggtatcagctgatccctggcagtgccccacgaacctgatctacgcgacacatccggaacacagttctgggtccccgatcggttcaggagcagatccgaaacacagctactctgaccatcagctcctgcaggctgaggacgaagcagattatttctgcgcatctgccgaggactctagttcaaatgccgtgttggaagcggcaccacactgacagtccaggtcagcccaaggctcaactccccgtcactgtttccgccctcctctgaggagcttaagccggagccgtgacagtgcctgaaggcagatagcaacttctaccccggagccgggaggccagaagcgccacccgagcctgagcgcctagcaacaacaagtacgcggccacagaagctacagctgccaggtcacgcatgagggagcaccgtggagaagacagtgccctacacgaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 211 | BLV1H12 GGS2.2 ProTxII | BLV1H12 LC CowV HuLamC | 131-73 | caggccgtcctgaaccagccaagcagcgtctccggtctggggc agcggtctcaatcacctgtagcgggtcttcctccaatgtgggcaac ggctacgtgtcttggtatcagctgatccctggcagttctccccacgaacc ctgatctacggcgacacatccagagcttctgggtgcccgatcggttc tcaggcagatccggaaacacagctactctgaccatcagctccc tgcaggctgaggaggacgaagcagatattcttgcgcatctgccgaggac tctagttcaaatgccgtgttggaaggggcaccacactgacagtccta ggtcagcccaaggctcagtcccctcgttcccgcctctct gaggagcttcaagcccacaaggccacactggctgaaggcagtagca actctaccccggagccgtgacagtggcctgaagtgctcagactgacgcct gccccgtcaaggcgggagtggagaccacaccctccaaacaa agcaacaacaagtacgcggccacagcagctcagcctgagcctgacgcat gagcagtggaagtccacagaagacagctcagcctgagcctgacgcat gaagggagcaccgtgagaagacagtgcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 212 | BLV1H12 GGS2.4 ProTxII | BLV1H12 LC CowV HuLamC | 131-73 | caggccgtcctgaaccagccaagcagcgtctccggtctggggc agcggtctcaatcacctgtagcgggtcttcctccaatgtgggcaac ggctacgtgtcttggtatcagctgatccctggcagttctccccacgaacc ctgatctacggcgacacatccagagcttctgggtgcccgatcggttc tcaggcagatccggaaacacagctactctgaccatcagctccc tgcaggctgaggaggacgaagcagatattcttgcgcatctgccgaggac tctagttcaaatgccgtgttggaaggggcaccacactgacagtccta ggtcagcccaaggctcagtcccctcgttcccgcctctct gaggagcttcaagcccacaaggccacactggctgaaggcagtagca actctaccccggagccgtgacagtggcctgaagtgctcagactgacgcct gccccgtcaaggcgggagtggagaccacaccctccaaacaa agcaacaacaagtacgcggccacagcagctcagcctgagcctgacgcat gagcagtggaagtccacagaagacagctcagcctgagcctgacgcat gaagggagcaccgtgagaagacagtgcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | SEQ ID NO: (VL aa) |
|---|---|---|---|---|---|---|---|
| 213 | BLV1H12 GGS4:2 ProTxII | BLV1H12 LC CowV HuLamC | 131-73 | caggccgtcctgaaccagccaagcagcgtctccggtctctgggc agcgggtctcaatcacctgtagcgggtcttcctccaatgtcggcaac ggctacgtgtcttggtatcagcctgccgaaccc ctgatctacggcgacaacatccagagctctgggtcccgatcggttc tcaggagcagatccgaaacacagtactctgaccatcagctccc tgcaggctgaggacgaagcagattattgcgcatctgccgaggac tctagttcaaatgccgtgttggaagcggcaccacactgacagtccta ggtcagcccaaggctcaagcccctcggtcactctgttcccgccctctct gaggagcttcaagccaacaaggccacagtggcctgaaggcagatagca actctaccccggagccgtgacaggcgtgagtggagaccaccctccaaacaa gcccgtcaaggcggggagtggcgccacgaagctcacagcctgacgcct agcaacaaacaagtacgcggccacagaagctacagcctgccagtcacgcat gagggagtgaagcaccgtgagaagacagtgcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 214 | BLV1H12 GGS2:2 GG-ProTxII-GG | BLV1H12 LC CowV HuLamC | 131-73 | caggccgtcctgaaccagccaagcagcgtctccggtctctgggc agcgggtctcaatcacctgtagcgggtcttcctccaatgtcggcaac ggctacgtgtcttggtatcagcctgccgaaccc ctgatctacggcgacaacatccagagctctgggtcccgatcggttc tcaggagcagatccgaaacacagtactctgaccatcagctccc tgcaggctgaggacgaagcagattattgcgcatctgccgaggac tctagttcaaatgccgtgttggaagcggcaccacactgacagtccta ggtcagcccaaggctcaagcccctcggtcactctgttcccgccctctct gaggagcttcaagccaacaaggccacagtggcctgaaggcagatagca actctaccccggagccgtgacaggcgtgagtggagaccaccctccaaacaa gcccgtcaaggcggggagtggcgccacgaagctcacagcctgacgcct agcaacaaacaagtacgcggccacagaagctacagcctgccagtcacgcat gagggagtgaagcaccgtgagaagacagtgcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 215 | BLV1H12 GGS 2:3 GG-ProTxII-GG | BLV1H12 LC CowV HuLamC | 131-73 | caggccgtcctgaaccagccaagcagcgtctccggtctggggcagcgggtctcaaatcacctgtagcgggtcttcctccaatgtcggcaacggctacgtgtcttggtatcagcctgatcccgggcaccgaaccctgatctacggcgacacatccgagcttctgggtccccgatcggttcaggagcagatccggaaacacagctactctgaccatcagctccctgcaggctgaggacgaagcagattattctgcgcatcgccgaggactctagttcaaatgccgtgtttggaagcggcaccacactgacagtccctaggtcagcccaaggctgccccctcggtcactcttgttccgccctctctgaggagcttcaagccaacaaggccacactggcctggaaggcagatgcaactctaccccgggagcggggagtggccagtgacacagctgagccctgacgctgagccccgtcaaggcgggagtgaagccgccagcgctatctgagcctgacgctgagccagtgaagtccacagaagcgttggacaaaccgcccactttcccccgggagaagacaccgtgagaagacagtgccctacagaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 216 | BLV1H12 GGS 2:4 GG-ProTxII-GG | BLV1H12 LC CowV HuLamC | 131-73 | caggccgtcctgaaccagccaagcagcgtctccggtctggggcagcgggtctcaaatcacctgtagcgggtcttcctccaatgtcggcaacggctacgtgtcttggtatcagcctgatcccgggcaccgaaccctgatctacggcgacacatccgagcttctgggtccccgatcggttcaggagcagatccggaaacacagctactctgaccatcagctccctgcaggctgaggacgaagcagattattctgcgcatcgccgaggactctagttcaaatgccgtgtttggaagcggcaccacactgacagtccctaggtcagcccaaggctgccccctcggtcactcttgttccgccctctctgaggagcttcaagccaacaaggccacactggcctggaaggcagatgcaactctaccccgggagcggggagtggccagtgacacagctgagccctgacgctgagccccgtcaaggcgggagtgaagccgccagcgctatctgagcctgacgctgagccagtgaagtccacagaagcgttggacaaaccgcccactttcccccgggagaagacaccgtgagaagacagtgccctacagaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | SEQ ID NO: (VL aa) |
|---|---|---|---|---|---|---|---|
| 217 | BLV1H12 GGS 3:2 GG-ProTxII-GG | BLV1H12 LC CowV HuLamC | 131-73 | caggccgtcctgaaccagccaagcagcgtctccggtctctgggc agcgggtctcaatcacctgagcgggtcttcctcctggcaaac ggctacgtgtctgttgtatccctggcagtgcccacgaacc ctgatctacggcgacaacatccagagcttctgggtccccgatcggttc tcaggagcagatccgaaacaacagctactctgaccatcagctccc tgcaggctgaggacgaagcagattattctgcgcatctgccgaggac tctagttcaaatgccgtgttggaagcggcaccacactgacagtccta ggtcagcccaaggctgccccctcggtcacctgtgtccgcccctctct gaggagcttcaagccggagccgtgacaggtggcctgaaggcagatgca actctaccggtgagcgggagtgggaccaccaccctccaaacaa gcccgtcaaggcggaggttcacggcccagcagctactacagcctgagcctgacgcct gagcagtgaagtccacagaagctacacagtgccaggtgacgcat gaagggagcaccgtggagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 218 | BLV1H12 GGS 3:3 GG-ProTxII-GG | BLV1H12 LC CowV HuLamC | 131-73 | caggccgtcctgaaccagccaagcagcgtctccggtctctgggc agcgggtctcaatcacctgagcgggtcttcctcctggcaaac ggctacgtgtctgttgtatccctggcagtgcccacgaacc ctgatctacggcgacaacatccagagcttctgggtccccgatcggttc tcaggagcagatccgaaacaacagctactctgaccatcagctccc tgcaggctgaggacgaagcagattattctgcgcatctgccgaggac tctagttcaaatgccgtgttggaagcggcaccacactgacagtccta ggtcagcccaaggctgccccctcggtcacctgtgtctcataagtg gaggagcttcaagccggagccgtgacaggtggcctgaaggcagatgca accctaccggtgagcgggagtgggaccaccaccctccaaacaa gcaacaacaagtacgcggtccacagaagctacacagtgccaggtgacgcct gagcagtgaagtccacagaagctacacagtgccaggtgacgcat gaagggagcaccgtggagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 219 | BLV1H12 GGS 4:2 GG-ProTxII-GG | BLV1H12 LC CowV HuLamC | 131-73 | caggccgtcctgaaccagccaagcagcgtctccggtctgggcagccgtctcaatcacctgagcgggtcttcctccaatgtcggcaacggctacgtgtcttggtatcagtcagccgaaccctgatctacggcgacacatccagagtcttctgggtcccgatcggttcaggagcagatccggaaacacagctactctgaccatcagctcctgcaggctgaggacgaagcagattattctgcgcatctccgaggactctagttcaaatgccgtgttggaagcggcaccactgacagtcctaggtcagcccaaggctgccccctgttcccgactcctctgaggagcttcaagcccggagccgtgacagtgcctgaaggcagagcaactctacccggagcgcggagtgaccagcaggctacgggccagcagccgtgaagaaccaagtacggccgcagcagcagtgaagacacagtgcgccagtgcagcgcacagctgcgccagtgcgccagtgccagtgcacaagacacagacacaagaa | 474 | QAVLNQPSSVSGSLGQRVSITCSGSSSNVGNGYVSWYQLIPGSAPRTLIYGDTSRASGVPDRFSGSRSGNTATLTISSLQAEDEADYFCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 807 |
| 220 | BLV1H12 GTLV 3xG4S ProTxII | BLV1H12 LC CowV HuLamC | 131-73 | caggccgtcctgaaccagccaagcagcgtctccggtctgggcagccgtctcaatcacctgagcgggtcttcctccaatgtcggcaacggctacgtgtcttggtatcagtcagccgaaccctgatctacggcgacacatccagagtcttctgggtcccgatcggttcaggagcagatccggaaacacagctactctgaccatcagctcctgcaggctgaggacgaagcagattattctgcgcatctccgaggactctagttcaaatgccgtgttggaagcggcaccactgacagtcctaggtcagcccaaggctgccccctgttcccgactcctctgaggagcttcaagcccggagcgtgacagtgcctgaaggcagagatacgggccccgtcaaggcaagccggaagtgcggccagcagtacgcggccaccagagtcactgagcctgagcctgcccaagcaacaacaagtacggccagtgaagtccggccagcagtacgcggccaccagagtcactgagcctgagcctgcccaagcaacaacaagtacggccagtgcagcgcacagctgcgccagtgcgccagtgccagtgcacaagacacagtgcgccagtgcagcgcacagctgcgccagtgcgccagtgccagtgcacaagacacagaa | 474 | QAVLNQPSSVSGSLGQRVSITCSGSSSNVGNGYVSWYQLIPGSAPRTLIYGDTSRASGVPDRFSGSRSGNTATLTISSLQAEDEADYFCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | SEQ ID NO: (VL aa) |
|---|---|---|---|---|---|---|---|
| 221 | BLV1H12 GTLV 3xG4S ShK | BLV1H12 LC CowV HuLamC | 131-73 | caggccgtcctgaaccagccaagcagcgtctccggtctctggggc agcgggtctcaatcacctgagcgggtcttcctccaatgtcggcaac ggctacgtgtctgttgtatcagctgatcctggcagtgcccacgaacc ctgatctacggcgacacatccgagcttctgggtccccgatcggttc tcaggagcagatccggaaacacagtactctgaccatcagctcc tgcaggctgaggacgaagcagattatttctgcgcatctgccgaggac tctagttcaaatgccgtgtttggaaggcgcaccacactgacagtccta ggtcagcccaaggctcaagccccaacaaggccacagtgcctgaaggcagatagca actctaccccggagccgtgacagtggcctgaaggcagatagca gcccgtcaaggcgggagtggagaccaccacccccaaacaa agcaacaacaagtacgcggccagcagctacagtctgagcctgacgcct gagcagtggaagtccacagaagctacacagtgccaggtcacgcat gaagggagcaccgtgagaaagacagtggcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 222 | BLV1H12 GTLV 3xG4S OSK1 (K16, D20) | BLV1H12 LC CowV HuLamC | 131-73 | caggccgtcctgaaccagccaagcagcgtctccggtctctggggc agcgggtctcaatcacctgagcgggtcttcctccaatgtcggcaac ggctacgtgtctgttgtatcagctgatcctggcagtgcccacgaacc ctgatctacggcgacacatccgagcttctgggtccccgatcggttc tcaggagcagatccggaaacacagtactctgaccatcagctcc tgcaggctgaggacgaagcagattatttctgcgcatctgccgaggac tctagttcaaatgccgtgtttggaaggcgcaccacactgacagtccta ggtcagcccaaggctcaagccccaacaaggccacagtgcctgaaggcagatagca actctaccccggagccgtgacagtggcctgaaggcagatagca gcccgtcaaggcgggagtggagaccaccacccccaaacaa agcaacaacaagtacgcggccagcagctacagtctgagcctgacgcct gagcagtggaagtccacagaagctacacagtgccaggtcacgcat gaagggagcaccgtgagaaagacagtggcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 223 | BLV1H12 GTLV 3xG4S OSK1 (P12,K16,D 20) | BLV1H12 LC CowV HuLamC | 131-73 | caggccgtcctgaaccagccaagcagcgtctccggtctctggggc agcgggtctcaatcacctgtagcgggtcttcctccaatgtcggcaac ggctacgtgtcttgtatcagctgccctggcagtgcccacgaacc ctgatctacgggcgacacatccagagcttctgggtccccgatcggttc tcagggagcagatccgaaaacacagctactctgcaccatcagctccc tgcaggctgaggacgaagcagattattctgcgcatctgccgaggac tctagttcaaatgccgtgtttggaacgggcaccacactgacagtccta ggtcagcccaaggctgccccctcgtcactctgttccgcctctct gaggagcttcaagccacaaggcctgacagtggcctgaaggcagatagca acttctaccccggggagtgcggagaccacactccaaacaa agcaacaacaagtacgggccagcagctatctgagcctgacgcct gagcagtgaagtccaccacagaagctacagctgccagtcacgcat gaagggagcaccgtgagaagacagtgccctacagaatgtt ca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 79, 224 | BLV1H12 GTLV 3xG4S GpTx-1 | BLV1H12 LC CowV HuLamC | 131-73 | caggccgtcctgaaccagccaagcagcgtctccggtctctggggc agcgggtctcaatcacctgtagcgggtcttcctccaatgtcggcaac ggctacgtgtcttgtatcagctgccctggcagtgcccacgaacc ctgatctacgggcgacacatccagagcttctgggtccccgatcggttc tcagggagcagatccgaaaacacagctactctgcaccatcagctccc tgcaggctgaggacgaagcagattattctgcgcatctgccgaggac tctagttcaaatgccgtgtttggaacgggcaccacactgacagtccta ggtcagcccaaggctgccccctcgtcactctgttccgcctctct gaggagcttcaagccacaaggcctgacagtggcctgaaggcagatagca acttctaccccggggagtgcggagaccacactccaaacaa agcaacaacaagtacgggccagcagctatctgagcctgacgcct gagcagtgaagtccaccacagaagctacagctgccagtcacgcat gaagggagcaccgtgagaagacagtgccctacagaatgtt ca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 225 | BLV1H12 GTLV 6xG4S | BLV1H12 LC CowV HuLamC | 131-73 | caggccgtcctgaaccagccaagcagcgtctccggtctctggggcagcgggtctcaatcacctgtagcgggtcttcctccaatgtcggcaacggctacgtgtcttggtatcagctgatccctggcagtcccgatcggttctgatctacggcgacacatccgagaacacactctgtggtcccgatcggttctgatctacggcgacacatccgagaacacactctgtggtcccgatcggttctgatctacggcgacacatccgagaacacactgactcagctcctgcaggccgtgaggacgaagcagattatttctgcgcatctgccgaggactctagttcaaatgccgtgtttggaagcggcaccacactgacagtccctaggtcagcccaaggctgccctgcaggccgccgtgtcttccgcccctctgaggagcttcaagccgtacagtgcctggaaggcagatagcaactctaccggcgggtcaagtggtgaggtgggtcaacccctcaaacaagcaacaacaagtacgcggccagcagaagctactacagtctgagcctgacctgaggagcagcagcagaagcagcagaagctactacagtctgagcctgacctgaggagcagcagcagaagcagaagcagcagaagctactacagtctgagcctgaggagcagcagcagaagcagaagcagcagaagctactacagtctgagcctgacctgaggagcagcagcagacagtgccctacagaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 226 | BLV1H12 GTLV 1xG4S Bsals (wStop) | BLV1H12 LC CowV HuLamC | 131-73 | caggccgtcctgaaccagccaagcagcgtctccggtctctggggcagcgggtctcaatcacctgtagcgggtcttcctccaatgtcggcaacggctacgtgtcttggtatcagctgatccctggcagtcccgatcggttctgatctacggcgacacatccgagaacacactctgtggtcccgatcggttctgatctacggcgacacatccgagaacacactgactcagctcctgcaggccgtgaggacgaagcagattatttctgcgcatctgccgaggactctagttcaaatgccgtgtttggaagcggcaccacactgacagtccctaggtcagcccaaggctgccctgcaggccgccgtgtcttccgcccctctgaggagcttcaagccgtacagtgcctggaaggcagatagcaactctaccggcgggtcaagtggtgaggtgggtcaacccctcaaacaagcaacaacaagtacgcggccagcagaagctactacagtctgagcctgacctgaggagcagcagcagaagcagcagaagctactacagtctgagcctgacctgaggagcagcagcagaagcagaagcagcagaagctactacagtctgagcctgaggagcagcagcagaagcagaagcagcagaagctactacagtctgagcctgacctgaggagcagcagcagacagtgccctacagaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 25, 228 | BLV1H12 GLLV 3xG4S ProTxII | BLV1H12 LC CowV HuLamC | 131-73 | caggccgtcctgaaccagccaagcagcgtctccggtctctggggc agcgggtctcaatcacctgtagcgggtcttcctccaatgtcggcaac ggctacgtgtcttggtatcagcttgatcctggcagtgcccacgaacc ctgatctacgcgacacatccagagcttctgggtccccgatcggttc tcaggagcagatccgaaacacagctactctgcgcatctgaccagctccc tgcaggctgaggacgaagcagattatttctgcgcatcgccgaggac tctagttcaaatgccgtgttttgaaagcggcaccacactgacagtccta ggtcagccaaggctcaagcccctcggtcacttccgtcccgcctctct gaggagcttcaagccaacaaggccacagtggcctgaaggcagatagca actctaccccgggagcggggagtgcggccacagagctactgagcctgacgcct agcaacaacaagtacggcggtccacagaagctacagctgccaggtcacgcat gaagggagcaccgtgagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 29, 40, 229 | BLV1H12 GLLV 3xG4S ShK | BLV1H12 LC CowV HuLamC | 131-73 | caggccgtcctgaaccagccaagcagcgtctccggtctctggggc agcgggtctcaatcacctgtagcgggtcttcctccaatgtcggcaac ggctacgtgtcttggtatcagcttgatcctggcagtgcccacgaacc ctgatctacgcgacacatccagagcttctgggtccccgatcggttc tcaggagcagatccgaaacacagctactctgcgcatctgaccagctccc tgcaggctgaggacgaagcagattatttctgcgcatcgccgaggac tctagttcaaatgccgtgttttgaaagcggcaccacactgacagtccta ggtcagccaaggctcaagcccctcggtcacttccgtcccgcctctct gaggagcttcaagccaacaaggccacagtggcctgaaggcagatagca actctaccccgggagcggggagtgcggccacagagctactgagcctgacgcct agcaacaacaagtacggcggtccacagaagctacagctgccaggtcacgcat gaagggagcaccgtgagaagacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 26, 230 | BLV1H12 GLLV 3xG4S OSK1 (K16,D20) | BLV1H12 LC CowV HuLamC | 131-73 | caggccgtcctgaaccagccaagcagcgtccgggtctctgggc agcgggtctcaatcacctgtagcgggtcttcctccaatgtcggcaac ggctacgtgtcttggtatcagcctgatcccggcagtgcccacgaacc ctgatctacggcgacacatccagagcttctgggtccccgatcggttc tcagggagcagatccggaaacacagctactctgaccatcagctccc tgcaggctgaggacgaagcagattatttctgcgcatctgccgaggac tctagttcaaatgccgtgttttggaagcggcaccacactgacagtcctta ggtcagcccaaggctcaaccctcggttctcactctgttcccgcctctct gaggagcttcaagccacaaaggccacactggcctgaaggcagatgca actctaccccgggagccgtgacagtgcctgaagtgactatagagcat agcaacaacaagtacggccagcagctatctgagcctgacgcct gaaggcagtggaagtccacagaagctacagctgccaggtcacgcat gaagggagcaccgtggagagaagacagtggcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 27, 231 | BLV1H12 GLLV 3xG4S OSK1 (P12,K16,D 20) | BLV1H12 LC CowV HuLamC | 131-73 | caggccgtcctgaaccagccaagcagcgtccgggtctctgggc agcgggtctcaatcacctgtagcgggtcttcctccaatgtcggcaac ggctacgtgtcttggtatcagcctgatcccggcagtgcccacgaacc ctgatctacggcgacacatccagagcttctgggtccccgatcggttc tcagggagcagatccggaaacacagctactctgaccatcagctccc tgcaggctgaggacgaagcagattatttctgcgcatctgccgaggac tctagttcaaatgccgtgttttggaagcggcaccacactgacagtcctta ggtcagcccaaggctcaaccctcggttctcactctgttcccgcctctct gaggagcttcaagccacaaaggccgtcagtgcctgaaggcagatgca actctaccccgggagcggagtgacagtgcctgaagtgactatagagcca gccccgtcaaggccgtgacagtggagaaccacacactccaaaca agcaacaacaagtacggccagcagctatctgagcctgacgcct gagcagtgaagtccacagaagctacagctgccaggtcacgcat gaagggagcaccgtggagagaagacagtggcccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQWKSHRS YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 28, 232 | BLV1H12 GLLV 3xG4S GpTx-1 | BLV1H12 LC CowV HuLamC | 131-73 | caggccgtcctgaaccagccaagcagcgtctccggtctctgggc agcgggtctcaatcacctgagcgggtcttcctccaatgtcggcaac ggctacgtgtcttggtatcagctgatccctggcagtgcccacgaacc ctgatctacgqcgaacacatccagagcttctgggtcccgatcggttc tcaggcagatccggaaacacagctactctgaccatcagctcc tgcaggctgaggacgaagcagattatttctgcgcatctgccggagac tctagttcaaaatgccgtgtttggaagggcaccacactgacagtccta ggtcagcccaaggctgcccctcggtcacttctgttccgccctctct gaggagcttcaaggaccaacaaggcctgacagtgcctgaaggcagatgca acttctaccccggagccgtgacagtgcggccgccaccaccctccaaaca gccaacaacaagtacgcggccagcagttacagcctgagcctgacc gagcagtggaagtccacagaagagccacacagcgccagtcacgcat gaagggagcaccgtggagaagacagtgcccctacagaatgttc a | 474 | QAVLNQPSSVSGSLGQRVS ITCSGSSSNVGNGYVSWYQ LPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 34 | VH4-34 MutA IL-8 CD1Cow | VL1-51 S2A, T5N, P8S, A12G, A13S, P14L | 132-25 | caggccgtcctgaaccagccaagcagcgtctccggtctctgggc agaaggtgactatcagctgtctgctcatcaagcaacatcggaaat aattacgtcagctggtaccagcagctgcctgaacagctcctaaact gctcatttatgacaataacaagcgccatccgaatcctgaccgat tcagcggaagcaaatcagggacctcgcaactctggaaactactgg gcttcagacagagagatgagcagattactattgcgcctctgcagag gacagctccagcaatgccgtgttcggtgtctgttaccactcttacagtc ctaggtcagccagccaaggctgccccctcggtcacttgttccgcctcc tctgaggagcttcaccccggagccgtgacagtggcctgaagcagatagc tgacttctaccccgagccgtgactgtgagaccacccccaaaca agcaacaacaagtacgcggccagtgacagctacagcctgagcctgacc ctgagcagtggaagtccacagaaagctacagcctgcaggtcacgc atgaaggagcaccgtggagaagacagtgcccctacagaatgttc ca | 443 | QAVLNQPSSVSGSLGQKVTI SCSGSSSNIGNNYVSWYQQ LPGTAPKLLIYDNNKRPSGIP DRFSGSKSGTSATLGITGLQ TGDEADYYCASAEDSSSNA VFGSGTTLTVLGQPKAAPS VTLFPPSSEELQANKATLVC LISDFYPGAVTVAWKADSSP VKAGVETTTPSKQSNNKYA ASSYLSLTPEQWKSHRSYS CQVTHEGSTVEKTVAPTEC S | 804 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 35 | VH4-34 IL-8 CDR1cow CDR2cow | VL1-51 Lc | 132-21 | caggccgtcctgaaccagccaagcagcgtctccggtctctggggc agaaggtgactatcagctctctggctcatcaagcaacatgggaat aattacgtcagctggtaccagcagctgcctggaacagtcctagaa ccctcatttatggcgacaacaaagcgccatccgaatcctgaccg atcagcggaagcaaatcaggagacctctgcaactctggaatcact gggcttcagacaggagatgaggcagattactattcgcctctgcag aggacagctccagcaatgcgtgttcggtgtggtaccactcttaca gtcctaggtcagcccaaggctgcccctcggtcactcttccgcc tcctctgaggagcttcaaggccgtgacagtgcctgaaggcagat aagtgactttacccgtcaaggcgggagttgaaacaacacctccaa agcagccccgtcaaggcaacaagtacgcggccagcagctatgagcctga cgcctgagcagtgaagtccacagaagactacagctgccaggtca cgcatgaagggagccacgtggagaagacagtgcccctacagaa tgtca | 456 | QSVLTQPPSVSAAPGQKVTI SCSGSSSNIGNNYVSWYQQ LPGTAPKLLIYDNNKRPSGIP DRFSGSKSGTSATLGITGLQ TGDEADYYCASAEDSSSNA VFGSGTTLTVLGQPKAAPS VTLFPPSSEELQANKATLVC LISDFYPGAVTVAWKADSSP VKAGVETTTPSKQSNNKYA ASSYLSLTPEQWKSHRSYS CQVTHEGSTVEKTVAPTEC S | 805 |
| 36 | VH4-34 MutB IL-8 CDR1cow CDR2cow | VL1-51 S2A, T5N, P8S, A12G, A13S, P14L | 132-25 | caggccgtcctgaaccagccaagcagcgtctccggtctctggggc agaaggtgactatcagctctctggctcatcaagcaacatgggaat aattacgtcagctggtaccagcagctgcctggaacagtcctagaa ccctcatttatggcgacaacaaagcgccatccgaatcctgaccg atcagcggaagcaaatcaggagacctctgcaactctggaatcact gggcttcagacaggagatgaggcagattactattcgcctctgcag aggacagctccagcaatgcgtgttcggtgtggtaccactcttaca gtcctaggtcagcccaaggctgcccctcggtcactcttccgcc tcctctgaggagcttcaaggccgtgacagtgcctgaaggcagat aagtgactttacccgtcaaggcgggagttgaaacaacacctccaa agcagccccgtcaaggcaacaagtacgcggccagcagctatgagcctga cgcctgagcagtgaagtccacagaagactacagctgccaggtca cgcatgaagggagccacgtggagaagacagtgcccctacagaa tgtca | 443 | QAVLNQPSSVSGSLGQKVTI SCSGSSSNIGNNYVSWYQQ LPGTAPKLLIYDNNKRPSGIP DRFSGSKSGTSATLGITGLQ TGDEADYYCASAEDSSSNA VFGSGTTLTVLGQPKAAPS VTLFPPSSEELQANKATLVC LISDFYPGAVTVAWKADSSP VKAGVETTTPSKQSNNKYA ASSYLSLTPEQWKSHRSYS CQVTHEGSTVEKTVAPTEC S | 804 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 37 | VH4-34 MutC IL-8 31D32K50S | VL1-51 S2A, T5N, P8S, A12G, A13S, P14L, K46R, L47T, D51G, N52D, N53T | 132-27 | caggccgtcctgaaccagccaagcagcgtctccgggtctctggggc agaaggtgactatcagctgctctggctctcatcaagcaacatgggaat aattacgtcagctggtaccagcagctgcctgaacagctcctagaa ccctcatttatggcgacacaaagcgcccatccgaatcctgaccg atcagcggaagcaaatcaggagacctctgcaactctggaatcact gggcttcagaacagaggaggcagattactattgcgcctctgcag aggacagctcagcaatgccgtgttcgggtctgttaccactcttaca gtcctaggtcagcccaaggctgccccctcgtcacctgttcccgcc tcctctgaggagcttcaagccaacaaggccacactggtgtctcat aagtgactctacccggtcaaggcgggagttgacagtgcctgaaggcagat agcagcccgtcaaggcaacaacaagtacgcggccagcagctatcgagcctga acaaagcagtggaaggagcaccgtgagaagacagtgccccactacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 38 | VH4-34 MutE IL-8 5R6E31D3 2K50S | VL1-51 S2A, T5N, P8S, A12G, A13S, P14L, K46R, L47T, D51G, N52D, N53T | 132-27 | caggccgtcctgaaccagccaagcagcgtctccgggtctctggggc agaaggtgactatcagctgctctggctctcatcaagcaacatgggaat aattacgtcagctggtaccagcagctgcctgaacagctcctagaa ccctcatttatggcgacacaaagcgcccatccgaatcctgaccg atcagcggaagcaaatcaggagacctctgcaactctggaatcact gggcttcagaacagaggaggcagattactattgcgcctctgcag aggacagctcagcaatgccgtgttcgggtctgttcactctgttcccgcc tcctctgaggagcttcaagccaacaaggccacactggtgtctcat aagtgactctacccggtcaaggcgggagttgacagtgcctgaaggcagat agcagcccgtcaaggcaacaacaagtacgcggccagcagctatcgagcctga acaaagcagtggaaggtccacagaagctacagcagctatcgagcctga cgcctgagcagcagtggaaggtccacagaagctacagctgccagctgca cgcatgaaggaaggacaccgtgagaagacagtgccccactacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 39 | VH4-34 MutD IL-8 CDR1cow CDR2cow | VL1-51 S2A, T5N, P8S, A12G, A13S, P14L, K46R, L47T, D51G, N52D, N53T | 132-27 | caggccgtcctgaaccagccaagcagcgtctccggtctctggggc agaaggtgactatcagctgctctgctcatcaagcaacatgggaat aattacgtcagctggtaccagcagctgcctgaacagctctagaa ccctcatttatggcgacacaaaagcgccatccgaatcctgaccg atcagcggaagcaaatcaggagcctgcaactctggaatcact gggcttcagaacagaggagatgaggcagattactattgcgcctctgcag agaacagctcagcaaatgcgtgttcggctctgtctgtaccactcttaca gtcctagtcagcccaaggctcaccctcggtcactctgttccgcc tcctcgaggagcttcaccggagccgtgacagtgcctgaaggcagat aagtgacttctaccgggagccggagtgaaaccaacaccctccaa acaaagcaacaagtacgcggccagcagctatctgagcctga cgcctgagcagtggaagtccacagaagctacagctgccaggtca cgcatgagcaacagctgaagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 42 | BLV1H12 | BLV1H12 LC CowV HuLamC | 131-73 | caggccgtcctgaaccagccaagcagcgtctccggtctctgggc agcgggtcaatcacctgtagcggtcttctctcaatgtggcaac ggctacgtgtcttgtatcagctgatccggcagtgcccacgaacc ctgatctacggcgacacatcagagcttctgggtcccgatcggttc tcaggagcagatccgaaacacagcagcagatctgaccatcagctccc tgcaggctgaggacgaagcagattatttctgcgcatccgaggac tctagttcaaatgccgtgttggaaggcggcaccacactgacagtcta ggtcagcccaaggctgccccctcgtcactctgttcccgccctctct gaggagcttcaagccaacaaggccacactggtgtgtctcataagtg actctaccccggagccgtgacagtgcctgaaggcagatagca gccccgtcaaggcgggagttgagaccaacaccaccccaaacaa agcaacaacaagtacgcggccagcagctatctgagcctgacgcct gagcagtggaagtccacagaagctacagctgccaggtcacgcat gaagggagcaccgtggaagaacagtgccctacagaatgttc a | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPEQWKSHRS YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 43 | VH4-34 MutF IL-8 5R6E CD1cow | VL1-51 S2A, T5N, P8S, A12G, A13S, P14L, K46R, L47T, D51G, N52D, N53T | 132-27 | caggccgtcctgaaccagccaagcagcgtctccggtctctggggc agaaggtgactatcagctgctctggctcaatcaagcaacatgggaat aattacgtcagctggtaccagcagctgcctgaacagctcctagaa ccctcatttatggcgacacaaagcgcccatccgaatcctgaccg atcagcgggaagcaaatcaggagacctctgcaactctggaatcact gggcttcagacagacagtcctgcaattactattgcgcctctgcag aggacagctcagcaatgcgtgttcggtctgttaccactcttaca gtcctagtgtcagcccaaggtccccctggtcactctgttccgccc tcctcgaggagcttcaagccaacaaggccaacactgtgtgtcat aagtgactctaccccggagcgtggacagtgcctgaaggcagat agcagcccgtcaaggcggagtccaacaagtacgcggccagcagtcatcgagcctga cgcctgagcagttgaagtccacaagaagctacagctgccagtca cgcatgagcagtggagaccgtggagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 44 | BLV1H12-IL8 | BLV1H12 LC CowV HuLamC | 131-73 | caggccgtcctgaaccagccaagcagcgtctccggtctctgggc agcgggtctcaatcacctgagcgggtcttcctccaatgtcggcaac ggctacgtcgtttgtatcagctgacctgcagtgcccacgaacc ctgatctacgcgacacatccagagttctgggtccccgatcggtc tcaggagcagatccgaaaacacagctactctgaccatcagctccc tgcaggctgaggacgaagcagattatttcgcgcatcgccgaggac tctagttcaaatgccgtgttggaagcggcaccacactgacagtcta ggtcagccaaggctgcccctggtcactctgttcccgccctctct gaggagcttcaagccaacaaggccaacactgtgtgtctcataagtg acttctaccccggagcgtgacgtgcctgaaggcagatagca gcccgtcaaggcggggagtgcagccaccaccctccaaacaa agcaacaacaagtacgcccgcagcagctactacagcctgagcct gagcagtgaagtccacagaagctacagctgccagtcacgcat gaagggagcaccgtggagaagacagtggccctacagaatgttc a | 474 | QAVLNQPSSVSGSLGQRVS ITCSGSSSNVGNGYVSWYQ LIPGSAPRTLYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 45 | BLV1H12 HC CowV, CDR3 iL-8, 1xG4S | BLV1H12 LC CowV HuLamC | 131-73 | caggccgtcctgaaccagccaagcagcgtctccgggtctgggcagcgggtcaatcacctgtagcgggtcttcctccaatgtcggcaacggctacgtgtcttggtatcagcctgatcctgcagtcccacgaaccctgatctacggcgacacatccagagcttctgggtcccgatcggttcaggagcagatccggaaacacagattattctgcgatctgccgaggactgcaggctgaggacgaagcagattattctgcgcatctgccgaggactctagttcaaatgccgtgtttggaagcggcaccacactgacagtcctaggtcagcccaaggctcccccctcgttccgcttcctctactctacccgggagcctgacaagtgcctgaaggcagatgcagccccgtcaaggtgaagtggagtggccagcagctacagtcgccagttcagcatagcaacaacaagtacggccagcagctacagtcgccaggtcacgcatgaaggagagcacgtgagagacagtggcccctacagaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |
| 46 | BLV1H12 HC CowV, CDR3 iL-8, 3xG4S | BLV1H12 LC CowV HuLamC | 131-73 | caggccgtcctgaaccagccaagcagcgtctccgggtctgggcagcgggtcaatcacctgtagcgggtcttcctccaatgtcggcaacggctacgtgtcttggtatcagcctgatcctgcagtcccacgaaccctgatctacggcgacacatccagagcttctgggtcccgatcggttcaggagcagatccggaaacacagattattctgcgatctgccgaggactgcaggctgaggacgaagcagattattctgcgcatctgccgaggactctagttcaaatgccgtgtttggaagcggcaccacactgacagtcctaggtcagcccaaggctcccccctcgttccgcttcctctgaggagcttcaagccgtgacagtgcctgaaggcagatgcagccccgtcaaggtgaagtggagtggccagcagctacagtcgccagttcagcatagcaacaacaagtacggccagcagctacagtcgccaggtcacgcatgaaggagagcacgtgagagacagtggcccctacagaatgttca | 474 | QAVLNQPSSVSGSLGQRVS ITCSGSSSNVGNGYVSWYQ LIPGSAPRTLIYGDTSRASG VPDRFSGSRSGNTATLTISS LQAEDEADYFCASAEDSSS NAVFGSGTTLTVLGQPKAA PSVTLFPPSSEELQANKATL VCLISDFYPGAVTVAWKADS SPVKAGVETTTPSKQSNNK YAASSYLSLTPEQWKSHRS YSCQVTHEGSTVEKTVAPT ECS | 807 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 47 | VH4-34 MutE 3xG4S IL-8 | VL1-51 S2A, T5N, P8S, A12G, A13S, P14L, K46R, L47T, D51G, N52D, N53T | 132-27 | caggccgtcctgaaccagccaagcagcgtctccggtctcgggc agaaggtgactatcagctgctctggtctcatcaagcaacatgggaat aattacgtcagctggtaccagcagctgcctggaacagctcctagaa ccctcattatggcgacacaaatcaggagcccatccggaatcctgaccg atcagcggaagcaaatcaggagacctgcaactctggaatcact gggcttcagacagaggagatgaggcagattactattgcgcctctgcag aggacagctccagcaatgccgtgttcgggtctggtaccactcttaca gtcctagttcagccaaggtcagccctcgtcactcttcccgcc tcctctgaggagcttcaagcaaaccggtgacagtggcctgaaggcagat agtgactttaccggtgaaacaagtacaggccagcagctacagctgccagtca acaaagcaacaacaaagtacggccagcagtctacagctgccagtca cgcctgagcagtggaagtccacagaagctacagctgccaggtca cgcatgaagggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 48, 68, 72, 75, 80, 94, 100, 101, 111, 115.1 20, 123, 135 | VH4-34 MutE 3xG4S ShK | VL1-51 S2A, T5N, P8S, A12G, A13S, P14L, K46R, L47T, D51G, N52D, N53T | 132-27 | caggccgtcctgaaccagccaagcagcgtctccggtctcgggc agaaggtgactatcagctgctctggtctcatcaagcaacatgggaat aattacgtcagctggtaccagcagctgcctggaacagctcctagaa ccctcattatggcgacacaaatcaggagcccatccggaatcctgaccg atcagcggaagcaaatcaggagacctgcaactctggaatcact gggcttcagacagaggagatgaggcagattactattgcgcctctgcag aggacagctccagcaatgccgtgttcgggtctggtaccactcttaca gtcctagttcagccaaggtcagccctcgtcactcttcccgcc tcctctgaggagcttcaagcaaaccggtgacagtggcctgaaggcagat agtgactttaccggtgaaacaagtacaggccagcagctacagctgccagtca acaaagcaacaacaaagtacggccagcagtctacagctgccagtca cgcctgagcagtggaagtccacagaagctacagctgccaggtca cgcatgaagggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 49 | VH4-34 MutE 3xGGS MOKA | VL1-51 S2A, T5N, P8S, A12G, A13S, P14L, K46R, L47T, D51G, N52D, N53T | 132-27 | caggccgtcctgaaccagccaagcagcgtctccggtctctggggc agaaggtgactatcagctgctctggtctcatcaagcaacatgggaat aattacgtcagctggtaccagcagctgcctgaacagtcctagaa ccctcatttatggcgacacaaagcgccatccgaatcctgaccg atcagcggaagcaaatcagggaccctgcaactctggaatcact gggcttcagacagaggatgaggcagattactattgcgcctctgcag aggacagctccagcaatgcgtgttcggttcgtgtactcactcttaca gtcctaggtcagcccaaggctgcccctcggtcactcgttcccgcc tcctctgaggagcttcaccgggagccgtgacagtgcctgaaggcagat aagtgactttcaccgggagcgggagtgaaacaacccacactcccaa acaaagcaacaacaagtacgcggccagcagctatctgagcctga cgcctgagcagtggaagtccacagaagactacagctgccaggtca cgcatgaaggggagcaccgtggagaagacacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 50 | VH4-34 MutF 3xG4S ShK | VL1-51 S2A, T5N, P8S, A12G, A13S, P14L, K46R, L47T, D51G, N52D, N53T | 132-27 | caggccgtcctgaaccagccaagcagcgtctccggtctctggggc agaaggtgactatcagctgctctggtctcatcaagcaacatgggaat aattacgtcagctggtaccagcagctgcctgaacagtcctagaa cccctcatttatggcgacacaaagcgccatccgaatcctgaccg atcagcggaagcaaatcagggaccctgcaactctggaatcact gggcttcagacagaggatgaggcagattactattgcgcctctgcag aggacagctccagcaatgcgtgttcggttcgtgtactcactcttaca gtcctaggtcagcccaaggctgcccctcggtcactcgttcccgcc tcctctgaggagcttcaccgggagcgtgacagtgcctgaaggcagat aagtgactttcaccgggagcgggagtgaaacaacccacactcccaa acaaagcaacaacaagtacgcggccagcagctatctgagcctga cgcctgagcagtggaagtccacagaagactacagctgccaggtca cgcatgaaggggagcaccgtggagaagacacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 51 | VH4-34 MutF 3xG4S IL-8 | VL1-51 S2A, T5N, P8S, A12G, A13S, P14L, K46R, L47T, D51G, N52D, N53T | 132-27 | caggccgtcctgaaccagccaagcagcgtctccggtctctgggc agaaggtgactatcagctgctctgctcatcaagcaacatcgggaat aattacgtcagctggtaccagcagctgcctgaacagctcctagaa ccctcatttatggcgacacaaagcgccatccggaatccctgaccg atcagcggaagcaaatcaggagacctctgcaactctggaatcact gggcttcagacaggagatgaggcagattactattgcgcctctgcag aggacagctccagcaatgcgttcggtctgtacactcttaca gtcctaggtcagcccaaggctcaagccaagccgtgacagtgcctgaaggcagat aagtgacttctaccggggagcccgtgaaacaaggccacactggtgtctcat agcagccccgtcaaggcggagtgaaacaccacacctccaa acaaagcaacaaagtacgcccagcagcagcagtatctgagcctga cgcctgagcagtggaagtccacagaagactacagctgccaggtca cgcatgaagggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 52 | VH4-34 MutF 3xGGS MOKA | VL1-51 S2A, T5N, P8S, A12G, A13S, P14L, K46R, L47T, D51G, N52D, N53T | 132-27 | caggccgtcctgaaccagccaagcagcgtctccggtctctgggc agaaggtgactatcagctgctctgctcatcaagcaacatcgggaat aattacgtcagctggtaccagcagctgcctgaacagctcctagaa ccctcatttatggcgacacaaagcgccatccggaatccctgaccg atcagcggaagcaaatcaggagacctctgcaactctggaatcact gggcttcagacaggagatgaggcagattactattgcgcctctgcag aggacagctccagcaatgcgttcggtctgtacactcttaca gtcctaggtcagcccaaggctcaagccaagccgtgacagtgcctgaaggcagat aagtgacttctaccggggagcttcaagccgtgacagtgcctgaaggcagat agcagccccgtcaaggcgggagtgaaacaaccacacctccaa acaaagcaacaaagtacgcccagcagcagcagtatctgagcctga cgcctgagcagtggaagtccacagaagactacagctgccaggtca cgcatgaagggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 53, 155 | VH4-34 MutE 3xG4S ProTxII | VL1-51 S2A, T5N, P8S, A12G, A13S, P14L, K46R, L47T, D51G, N52D, N53T | 132-27 | caggccgtcctgaaccagccaagcagcgtctccggtctctggggc agaaggtgactatcagctgctctgctcatcaagcaacatcgggaat aattacgtcagctggtaccagcagctgcctgaacagctcctagaa ccctcatttatggcgacacaaagcgccatccgaatcctgaccg atcagcggaagcaaatcaggagccctctgcaactctggaatcact gggcttcagacagaggagcaatgcgtgttcggtctgttaccactcttaca agaacagctccagcaaatgcggctgccccctggtcactctgtccgcc tcctctgaggagcttcaagccgtgacagtggcctgaaggcagat aagtgacttctaccggggaccgtcaaggctgacagtgaaacaacccacctccaa acaaagcaacaacaagtacgcggccagcagtacagctgagctga cgcctgagcagtggaagtccacagaagacagtggccctacagaa cgcatgaaggggagcaccgtggagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 54, 78, 156 | VH4-34 MutE 3xG4S GPTX1 | VL1-51 S2A, T5N, P8S, A12G, A13S, P14L, K46R, L47T, D51G, N52D, N53T | 132-27 | caggccgtcctgaaccagccaagcagcgtctccggtctctggggc agaaggtgactatcagctgctctgctcatcaagcaacatcgggaat aattacgtcagctggtaccagcagctgcctgaacagctcctagaa ccctcatttatggcgacacaaagcgccatccgaatcctgaccg atcagcggaagcaaatcaggagccctctgcaactctggaatcact gggcttcagacagaggagcaatgcgtgttcggtctgttaccactcttaca agaacagctccagcaaatgcggctgccccctggtcactctgtccgcc tcctctgaggagcttcaaccgggaccgtcaaggctgacagtggcctgaaggcagat aagtgacttctaccggggaccgtgaagtgaaacaacccacctccaa agcagcccgtcaaggcgggagtgaaacaacaacccacctccaa acaaagcaacaacaagtacgcggccagcagtacagctgagctga cgcctgagcagtggaagtccacagaagacagtggccctacagaa cgcatgaaggggagcaccgtggagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 55, 64, 102, 110, 112, 121, 125, 160, 163, 166, 169 | VH4-34 MutE No Knob | VL1-51 S2A, T5N, P8S, A12G, A13S, P14L, K46R, L47T, D51G, N52D, N53T | 132-27 | caggccgtcctgaaccagccaagcagcgtctccgggtctctggggc agaaggtgactatcagctgtctgtctggctcatcaagcaacatgggaat aattacgtcagctggtaccagcagctgcctgaacagtcctagaa ccctcatttatggcgacacaaagcgccatccgaatcctgaccg atcagcggaagcaacaggaggacctcgcaactctggaatcact gggcttcagacagcagtgaggcagattactattgcgcctctgcag aggacagctccaggtcaggtctgtttcggtctgtaccactcttaca gtcctagttcagcccaaggctgcccctggtcactctgtccgcc tcctctgaggacttcaccgggagcgtgacagtgcctgaaggcagat aagtgactctaccccgtcaaggcgggagttgaaaacacacccctcc aa acaaagcaacaacaagtacgcggccagcagtctatctgagcctga cgcctgagcagtggaagtccacagaagctacagctgccaggtca cgcatgaagggagcaccgtgagaagacagtgcccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 56, 124, 145, 146, 147, 148 | VH4-34 MutE 1xG4S ShK | VL1-51 S2A, T5N, P8S, A12G, A13S, P14L, K46R, L47T, D51G, N52D, N53T | 132-27 | caggccgtcctgaaccagccaagcagcgtctccgggtctctggggc agaaggtgactatcagctgtctgtctggctcatcaagcaacatgggaat aattacgtcagctggtaccagcagctgcctgaacagtcctagaa ccctcatttatggcgacacaaagcgccatccgaatcctgaccg atcagcggaagcaacaggaggacctcgcaactctggaatcact gggcttcagacagcagtgaggcagattactattgcgcctctgcag aggacagctccaggtcaggtctgtttcggtctgtaccactcttaca gtcctagttcagcccaaggctgcccctggtcactctgtccgcc tcctctgaggacttcaccgggagcgtgacagtgcctgaaggcagat aagtgactctaccccgtcaaggcgggagttgaaaacacacccctcc aa acaaagcaacaacaagtacgcggccagcagtctatctgagcctga cgcctgagcagtggaagtccacagaagctacagctgccaggtca cgcatgaagggagcaccgtgagaagacagtgcccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 57 | VH4-34 MutE ShK-16K 1xG4S | VL1-51 S2A, T5N, P8S, A12G, A13S, P14L, K46R, L47T, D51G, N52D, N53T | 132-27 | caggccgtcctgaaccagccaagcagcgtctccgggtctctgggc agaaggtgactatcagctgtctggctcatcaagcaacatgggaat aattacgtcagctggtaccagcagctgcctggaacagtcctagaa ccctcatttatggcgacacaaaagcgcccatctgaatctgggaatcact atcagcggaagcaaatcaggagacgatgaggcagattactactgcgcctctgcag aggacagctcagcaagtccgttcggtctgtggtaccactcttaca gtcctaggtcagccaagctgccccctcggtcacctgttccgccc tcctctgaggagcttcaaggccgtgacagtggcctgaaggcagat aagtgactttctaccgggagcgggagtgaaacaaccacacctcgagcctga agcagccccgtcaaggcgtgaaagtccacagaagagctgccagaagagagagcagcagacgacagtggccctacagaa cgcctgagcagtggaagtccacagaagctacagctgccaggtca cgcatgaaggagcagtggagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 58 | MutE ShK-16K 3xG4S | VL1-51 S2A, T5N, P8S, A12G, A13S, P14L, K46R, L47T, D51G, N52D, N53T | 132-27 | caggccgtcctgaaccagccaagcagcgtctccgggtctctgggc agaaggtgactatcagctgtctggctcatcaagcaacatgggaat aattacgtcagctggtaccagcagctgcctggaacagtcctagaa ccctcatttatggcgacacaaaagcgcccatctgaatctgggaatcact atcagcggaagcaaatcaggagacgatgaggcagattactactgcgcctctgcag aggacagctcagcaagtccgttcggtctgtggtaccactcttaca gtcctaggtcagccaagctgccccctcggtcacctgttccgccc tcctctgaggagcttcaaggccgtgacagtggcctgaaggcagat aagtgactttctaccgggagcgggagtgaaacaaccacacctcgagcctga acaaagcagcagtggaagtccacagaagctacagctgccaggtca cgcctgagcagtggaagtccacagaagctacagctgccaggtca cgcatgaaggagcagtggagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 59, 137, 144, 149, 153, 159, 161, 162, 164, 165, 167, 168, 170, 171, 172, 173, 175, 176, 177, 178, 179 | VH4-34 MutE Shk- No Linker | VL1-51 S2A, T5N, P8S, A12G, A13S, P14L, K46R, L47T, D51G, N52D, N53T | 132-27 | caggccgtcctgaaccagccaagcagcgtctccgggtctctggggc agaaggtgactatcagctgtctggctcatcaagcaacatcgggaat aattacgtcagctggtaccagcagctgcctggaacagctcctagaa ccctcatttatggcgacaaagcgcccatccggaatcctgaccg atcagcggaagcagaggatgaggccgttgcccctcggtctctgcag aggacagctccagcccaatgccaaggccgtgttcggggctctgtttccgccc gtcctaggtcgaggagcttcaagccaacaaggccacactggtgtctcat aagtgactttctaccggagccgtgacagtgcctgaaggcagat agcagcccccgtcaagcgggagtgaagaaccacacccccaa acaaagcagcagtgaagttccacagaagtacagctgccaggtca cgcctgagcagtgaagttgaagtccacagaagtacagctgccaggtca cgcatgaagggagcaccgtggagaagacagtggcccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 60, 69, 73, 76, 138 | VH4-34 MutE G-ShK-G | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgcctcatcaagcaacatgggaat aattacgtcagctggtaccagcagctgcctgaacagctcctagaa ccctcatttatggcgacacaaaagcgcccatccgaactcctgaccg atcagcggaagcaaatcaggagaccctgcaactctggaatcact gggcttcagacagctccagtgatgaggcagattactattcgcctctgcag aggacagctccagcaatgccgtgttcggtctggtgtcactcttaca gtcctagttcagcgacttcaagccaaggctgacagttgcctgaaggcagat tcctctgaggagcttcaccgggagccgtgacagtgcctgaaggcagat aagtgacttctaccgggagcgtaaggcggagttgaaaacacctcccaa acaaagcaacaagtacgcggccagcagctacagctgcccaggtca cgcctgagcagtggaagtccacagaagacagtgagacagtgcctgccagtca cgcatgaaggaggccaccgtgagagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 61, 139 | VH4-34 MutE GG-ShK-GG | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgcctcatcaagcaacatgggaat aattacgtcagctggtaccagcagctgcctgaacagctcctagaa ccctcatttatggcgacacaaaagcgcccatccgaactcctgaccg atcagcggaagcaaatcaggagaccctgcaactctggaatcact gggcttcagacagctccagtgatgaggcagattactattcgcctctgcag aggacagctccagcaatgccgtgttcggtctggtgtcactcttaca gtcctagttcagcgacttcaagccaaggctgacagttgcctgaaggcagat tcctctgaggagcttcaccgggagccgtgacagtgcctgaaggcagat aagtgacttctaccgggagcgtaaggcggagttgaaaacacctcccaa acaaagcaacaagtacgcggccagcagctacagctgcccaggtca cgcctgagcagtggaagtccacagaagacagtgagacagtgcctgccagtca cgcatgaaggaggccaccgtgagagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 65, 140 | VH4-34 MutE GSGG-Shk-GGGG | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgctcatcaagcaacatgggaat aattacgtcagctggtaccagcagctgcctgaacagctcctagaa ccctcattatgggacacaaagcgccatccgaatcctgaccg atcagcggaagcaaatcaggagaccctgcaactctggaatcact gggcttcagacaggagatgaggcagattactattgcgcctctgcag aggacagctccagcaatgccgtgttcgggtctgtaccactcttaca gtcctagttcagccccaaggcttcaagccaaggtcaccactgttccgccc tcctctgaggagttcaagcaagccgtgacagtgcctgaaggcagat aagtgactctaccccgtcaaggcggagtgaaacaaccacctccaaa acaaagcaacaaagtacggccagcaagctacacagtgcaggtca cgcctgagcagtggaagtccacagagaccgtgagagagaaaca cgcatgaaggagcaccgtgagagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 66, 141 | VH4-34 MutE GGGG-Shk-GGGG | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgctcatcaagcaacatgggaat aattacgtcagctggtaccagcagctgcctgaacagctcctagaa ccctcattatgggacacaaagcgccatccgaatcctgaccg atcagcggaagcaaatcaggagaccctgcaactctggaatcact gggcttcagacaggagatgaggcagattactattgcgcctctgcag aggacagctccagcaatgccgtgttcgggtctgtaccactcttaca gtcctagttcagccccaaggcttcaagccaaggtcaccactgttccgccc tcctctgaggagttcaagcaagccgtgacagtgcctgaaggcagat aagtgactctaccccgtcaaggcggagtgaaacaaccacctccaaa acaaagcaacaaagtacggccagcaagctacacagtgcaggtca cgcctgagcagtggaagtccacagagaccgtgagagagaaaca cgcatgaaggagcaccgtgagagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 67, 70, 74, 77, 142 | VH4-34 MutE GGG-ShK-GGG | VL1-51 S2A, T5N, P8S, A12G, A13S, P14L, K46R, L47T, D51G, N52D, N53T | 132-27 | caggccgtcctgaaccagccaagcagcgtctccgggtctctggggc agaaggtgactatcagctgctctggtctcatcaagcaacatgggaat aattacgtcagctggtaccagcagctgcctgaacagtcctagaa ccctcatttatggcgacacaaagcgcccatccgaatcctgaccg atcagcggaagcaaatcaggagcctctgcaactctggaatcact gggcttcagacaggagatgaggcagattactattgcgcctctgcag aggacagctccagcaatgcgtgttcggtctgtgtaccactcttaca gtcctagttcagcccaaggctgccccctggtcactcgttcccgcc tcctctgaggacttcaccggagctcaagccgtacagtgcctgaaggcagat aagtgactctacccgtcaaggcgggagtgaaaaccacacccctccaa agcagcccgtcaaggcgggagtgaaaaccacacccctccaa acaaagcaacaaacaagtacgcggccagcagctatctgagcctga cgcctgagcagtgaagtccacagaagctacagctgccaggtca cgcatgaagggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 92, 95, 103 | VH4-34 MutE 3xG4S ShK S62G | VL1-51 S2A, T5N, P8S, A12G, A13S, P14L, K46R, L47T, D51G, N52D, N53T | 132-27 | caggccgtcctgaaccagccaagcagcgtctccgggtctctggggc agaaggtgactatcagctgctctggtctcatcaagcaacatgggaat aattacgtcagctggtaccagcagctgcctgaacagtcctagaa ccctcatttatggcgacacaaagcgcccatccgaatcctgaccg atcagcggaagcaaatcaggagcctctgcaactctggaatcact gggcttcagacaggagatgaggcagattactattgcgcctctgcag aggacagctccagcaatgcgtgttcggtctgtgtaccactcttaca gtcctagttcagcccaaggctgccccctggtcactcgttcccgcc tcctctgaggacttcaccggagctcaagccgtacagtgcctgaaggcagat agcagcccgtcaaggcgggagtgaaaaccacacccctccaa acaaagcaacaaacaagtacgcggccagcagctatctgagcctga cgcctgagcagtgaagtccacagaagctacagctgccaggtca cgcatgaagggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 104, 113, 119, 122 | VH4-34 MutE 2xG4S ShK | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgcctcatcaagcaacatgggaat aattacgtcagctggtaccagcagctgcctgaacagctcctagaa ccctcattatggcgacacaaagcgccatccggaatcctgaccg atcagcggaagcaaatcaggagaccctgcaactctggaatcact gggcttcagacaggaggatgaggcagattactattgcgcctctgcag aggacagctccagcaatgccgtgttcgggtctggtaccactcttaca gtcctagttcagcccaaggcttcaagccaacaaggcctgttccccc tcctctgagagcttctaccccggagccgtgacagttgcctgaaggcagat aagtgactttctaccccgtcaaggtggagttgaaacaaccaacctccaa acaaagcaacaaacaagtacggccagcagctacagctgagcctga cgcctgagcagtggaagtccacagaagctacagctgccaggtca cgcatgaagggagccaccgtggagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 105 | VH4-34 MutE 3xG4S ShK (M21Q) | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgcctcatcaagcaacatgggaat aattacgtcagctggtaccagcagctgcctgaacagctcctagaa ccctcattatggcgacacaaagcgccatccggaatcctgaccg atcagcggaagcaaatcaggagaccctgcaactctggaatcact gggcttcagacaggaggatgaggcagattactattgcgcctctgcag aggacagctccagcaatgccgtgttcgggtctggtaccactcttaca gtcctagttcagcccaaggcttcaagccaacaaggcctgttccccc tcctctgagagcttctaccccggagccgtgacagttgcctgaaggcagat aagtgactttctaccccgtcaaggtggagttgaaacaaccaacctccaa acaaagcaacaaacaagtacggccagcagctacagctgagcctga cgcctgagcagtggaagtccacagaagctacagctgccaggtca cgcatgaagggagccaccgtggagaagacagtggccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 106 | VH4-34 MutE 3xG4S ShK (M21L) | VL1-51 S2A, T5N, P8S, A12G, A13S, P14L, K46R, L47T, D51G, N52D, N53T | 132-27 | caggccgtcctgaaccagccaagcagcgtctccggtctctgggc agaaggtgactatcagctgtctggctcatcaagcaacatgggaat aattacgtcagctggtaccagcagctgcctgaacagctcctagaa ccctcatttatggcgacacaaagcgccatcctgaactctgaccg attcagcggaagcaaaatcaggagctctgcaactctggaatcact gggcttcagacagagatgaggcagattactattgcgcctctgcag aggacagctccagcaatgccgtgttcggtgtgtaccactcttaca gtcctaggtcagcccaaggctgcccctcggtcactcttcccgcc tcctctgaggagcttcaagccaacaaggccacactgtgtcttct aagtgactlctaccgggagccgtgacagtgcctgaaggcagat agcagccccgtcaaggtgaagtccacagaaagctacagtgcaggtca acaaagcaacaagtacgccagcagaagctacagtgcccctgaggtca cgcctgagcagtgaaggccaccgtgagaagagacagtgccccctacagaa cgcatgagcagtgaaggagcaccgtgagaagagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 107, 114 | VH4-34 MutE 3xG4S ShK (M21F) | VL1-51 S2A, T5N, P8S, A12G, A13S, P14L, K46R, L47T, D51G, N52D, N53T | 132-27 | caggccgtcctgaaccagccaagcagcgtctccggtctctgggc agaaggtgactatcagctgtctggctcatcaagcaacatgggaat aattacgtcagctggtaccagcagctgcctgaacagctcctagaa ccctcatttatggcgacacaaagcgccatcctgaactctgaccg attcagcggaagcaaaatcaggagctctgcaactctggaatcact gggcttcagacagagatgaggcagattactattgcgcctctgcag aggacagctccagcaatgccgtgttcggtgtgtaccactcttaca gtcctaggtcagcccaaggctgcccctcggtcactcttcccgcc tcctgaggacttctaccgggagccgtgagtgaaggccaaaggccacactctgtgtcttct aagtgactlctaccgggagccgtgagtgcctgaaggcagat agcagccccgtcaaggtcgggagttgaaaccacacctctgagcctga acaaagcaacaagtacgccagcagaagctacagtgcccctgaggtca cgcctgagcagtgaaggccaccgtgagaagagacagtgccccctacagaa cgcatgagcagtgaaggagcaccgtgagaagagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 108 | VH4-34 MutE 3xG4S ShK (M21I) | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgctcatcaagcaacatgggaat aattacgtcagctggtaccagcagcttcctggaacagtcctagaa ccctcatttatggcgacacaaagcgccatcctgaatcctgaccg atcagcggaagcaaagaggattgaggcagattactattgcgcctctgcag gggcttcagacagagaggatgaggcgtgttcggtcgtgtaccactcttaca aggacagctccagcaatgcgtcagcccaaggctgccccctcgttcccgccc gtcctaggtcagccaaggccttcaagccaacaaggccacactgtgtctcct tcctctgaggacttcaccgggagccgtgacagtggcctgaaggcagat agcagcccgtcaaggcgggagtggaaacaacaaccactccaa acaaaagcacagtggaagtccacagaagtacagctgagcctga cgccgagcaggagccgtgagaaggagaagaacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 109 | VH4-34 MutE 3xG4S ShK (M21A) | VL1-51 S2A, T5N, P8S, A12G, A13S, P14L, K46R, L47T, D51G, N52D, N53T | 132-27 | caggccgtcctgaaccagccaagcagcgtctccggtctgggc agaaggtgactatcagctgctctgctcatcaagcaacatgggaat aattacgtcagctggtaccagcagcttcctggaacagtcctagaa ccctcatttatggcgacacaaagcgccatcctgaatcctgaccg atcagcggaagcaaagaggattgaggcagattactattgcgcctctgcag gggcttcagacagagaggatgaggcgtgttcggtcgtgtaccactcttaca aggacagctccagcaatgcgtcagcccaaggctgccccctcgttcccgccc gtcctaggtcagccaaggccttcaagccaacaaggccacactgtgtctcct aagtgactttaccgggagccgtgacagtggcctgaaggcagat agcagcccgtcaaggcgggagtggaaacaacaaccactccaa acaaaagcacagtggaagtccacagaagtacagctgagcctga cgccgagcaggagccgtgagaaggagaagaacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

Figure 22 (continued)

| BIDs | IgG Name | Light Chain Name | Light Chain Plasmid # | VL-CL DNA Sequence | SEQ ID NO: (VL DNA) | VL-CL Amino Acid Sequence | Seq ID NO: (VL aa) |
|---|---|---|---|---|---|---|---|
| 157 | VH4-34MutE 1xG4S ProTxII | VL1-51 S2A, T5N, P8S, A12G, A13S, P14L, K46R, L47T, D51G, N52D, N53T | 132-27 | caggccgtcctgaaccagccaagcagcgtctctgggc agaaggtgactatcagctgctctgcctcatcaagcaacatgggaat aattacgtcagctggtaccagcagctgcctgaacagtcctagaa cctcattatggcgacacaaagcgcccatccggaatcctgaccg attcagcggaagcaaatcagggaccctgcaactctggaatcact gggcttcagacaggagatgaggcagattactatttgcgcctctgcag aggacagctccagcaatgccgttcggtgtgttaccactcttaca gtcctaggtcagccaaggctcaccctcggtcactcgttccgccc tcctctgaggagttcaccgggagccgtcaaggccgtgacagtgcctgaaggcagat aagtgactcctaccgcccgtcaaggggagtgaaaacacccctcaa acaaagcaacaagtacgcggccagcaagctacagtgccaggtca cgccatgaaggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |
| 158 | VH4-34MutE 1xG4S GPTX1 | VL1-51 S2A, T5N, P8S, A12G, A13S, P14L, K46R, L47T, D51G, N52D, N53T | 132-27 | caggccgtcctgaaccagccaagcagcgtctctgggc agaaggtgactatcagctgctctgcctcatcaagcaacatgggaat aattacgtcagctggtaccagcagctgcctgaacagtcctagaa cctcattatggcgacacaaagcgcccatccggaatcctgaccg attcagcggaagcaaatcagggaccctgcaactctggaatcact gggcttcagacaggagatgaggcagattactatttgcgcctctgcag aggacagctccagcaatgccgttcggtgtgttaccactcttaca gtcctaggtcagccaaggctcaccctcggtcactcgttccgccc tcctctgaggagttcaccgggagccgtcaaggccgtgacagtgcctgaaggcagat aagtgactcctaccgcccgtcaaggggagtgaaaacacccctcaa acaaagcaacaagtacgcggccagcaagctacagtgccaggtca cgccatgaaggagcaccgtggagaagacagtgccctacagaa tgttca | 486 | QAVLNQPSSVSGSLGQKVTI SCSGSSSNIGNNYVSWYQQ LPGTAPRTLIYGDTKRPSGI PDRFSGSKSGTSATLGITGL QTGDEADYYCASAEDSSSN AVFGSGTTLTVLGQPKAAP SVTLFPPSSEELQANKATLV CLISDFYPGAVTVAWKADSS PVKAGVETTTPSKQSNNKY AASSYLSLTPEQWKSHRSY SCQVTHEGSTVEKTVAPTE CS | 780 |

HUMANIZED ANTIBODIES WITH ULTRALONG COMPLEMENTARY DETERMINING REGIONS

CROSS REFERENCE

This application is a U. S. National stage Application under 35 U.SC. § 371 of International Patent Application No. PCT/US2014/047315, filed Jul. 18, 2014, which claims the benefit of priority of U.S. Provisional Application Ser. No. 61/856,010, filed Jul. 18, 2013, the entire contents of which are each incorporated herein by reference.

FIELD

The present disclosure relates to humanized antibodies, including antibodies comprising an ultralong CDR3.

The instant application contains a Sequence Listing which has been submitted in ASCII format via EFS-Web and is hereby incorporated by reference in its entirety. Said ASCII copy, created on Jan. 15, 2016, is named 13379-006-999_SequenceListing.txt and is 686,423 bytes in size.

BACKGROUND

Antibodies are natural proteins that the vertebrate immune system forms in response to foreign substances (antigens), primarily for defense against infection. For over a century, antibodies have been induced in animals under artificial conditions and harvested for use in therapy or diagnosis of disease conditions, or for biological research. Each individual antibody producing cell produces a single type of antibody with a chemically defined composition, however, antibodies obtained directly from animal serum in response to antigen inoculation actually comprise an ensemble of non-identical molecules (e.g., polyclonal antibodies) made from an ensemble of individual antibody producing cells.

Some bovine antibodies have unusually long VH CDR3 sequences compared to other vertebrates. For example, about 10% of IgM contains "ultralong" CDR3 sequences, which can be up to 61 amino acids long. These unusual CDR3 s often have multiple cysteines. Functional VH genes form through a process called V(D)J recombination, wherein the D-region encodes a significant proportion of CDR3. A unique D-region encoding an ultralong sequence has been identified in cattle. Ultralong CDR3s are partially encoded in the cattle genome, and provide a unique characteristic of their antibody repertoire in comparison to humans. Kaushik et al. (U.S. Pat. Nos. 6,740,747 and 7,196,185) disclose several bovine germline D-gene sequences unique to cattle stated to be useful as probes and a bovine VDJ cassette stated to be useful as a vaccine vector.

SUMMARY

The present disclosure provides humanized antibodies, including antibodies comprising an ultralong CDR3, methods of making same, and uses thereof.

The present disclosure provides a humanized antibody or binding fragment thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3.

In some embodiments, the humanized antibody or binding fragment thereof comprises one or more human variable region framework sequences.

In some embodiments of each or any of the above or below mentioned embodiments, the ultralong CDR3 is 35 amino acids in length or longer, 40 amino acids in length or longer, 45 amino acids in length or longer, 50 amino acids in length or longer, 55 amino acids in length or longer, or 60 amino acids in length or longer.

In some embodiments of each or any of the above or below mentioned embodiments, the ultralong CDR3 is 35 amino acids in length or longer.

In some embodiments of each or any of the above or below mentioned embodiments, the ultralong CDR3 comprises 3 or more cysteine residues, 4 or more cysteine residues, 5 or more cysteine residues, 6 or more cysteine residues, 7 or more cysteine residues, 8 or more cysteine residues, 9 or more cysteine residues, 10 or more cysteine residues, 11 or more cysteine residues, or 12 or more cysteine residues.

In some embodiments of each or any of the above or below mentioned embodiments, the ultralong CDR3 comprises 3 or more cysteine residues.

In some embodiments of each or any of the above or below mentioned embodiments, the antibodies or binding fragments thereof comprise a cysteine motif.

In some embodiments of each or any of the above or below mentioned embodiments, the cysteine motif is selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_5C$ (SEQ ID NO: 46), $CX_{10}CX_6CX_6CXCX_7C$ (SEQ ID NO: 47), $CX_{10}CX_4CX_7CXCX_5C$ (SEQ ID NO: 48), $CX_{10}CX_4CX_7CXCX_7C$ (SEQ ID NO: 49), $CX_{13}CX_5CX_5C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CX_5CXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_5CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CX_5CX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CX_5CX_7CXCX_6C$ (SEQ ID NO: 76), $CX_{10}CX_4CX_5CX_{12}CX_2C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_5CX_6C$ (SEQ ID NO: 82), $CX_{12}CX_4CX_5CX_5CX_2C$ (SEQ ID NO: 83), $CX_{12}CX_5CX_5CXCX_5C$ (SEQ ID NO: 84), $CX_{10}CX_6CX_5CXCX_4CXCX_9C$ (SEQ ID NO: 85), $CX_{11}CX_4CX_5CX_5CX_2C$ (SEQ ID NO: 86), $CX_{10}CX_6CX_5CX_5CX_2C$ (SEQ ID NO: 87), $CX_{10}CX_6CX_5CXCX_5C$ (SEQ ID NO: 88), $CX_{10}CX_6CXCXCX_3CX_5CX_2C$ (SEQ ID NO: 89), $CX_{10}CX_6CX_5CX_3CX_5C$ (SEQ ID NO: 90), $CX_{10}CX_6CX_5CXCX_2CX_6CX_5C$ (SEQ ID NO: 91), $CX_7CX_6CX_3CX_3CX_9C$ (SEQ ID NO: 92), $CX_9CX_5CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95).

In some embodiments of each or any of the above or below mentioned embodiments, the cysteine motif is selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_9CX_3CXCX_2CXCCCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_8CX_5CX_4CX_3CX_4CCXCX_1C$ (SEQ ID NO: 103), $CCX_6CCX_5CCCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCXCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_3CX_3C$ (SEQ ID NO: 112), $CX_5CCXCX_3CCX_3CXCX_3CX_4C$ (SEQ ID NO: 113), $CX_9CCX_4CX_2CXCCXCX_4CX_3C$ (SEQ ID NO: 114), $CX_{10}CXCX_3CX_2CXCCX_4CX_5CXC$ (SEQ ID NO: 115), $CX_9CXCX_3CX_2CXCCX_4CX_5CXC$ (SEQ ID NO: 116), $CX_6CCXCX_5CX_4CCXCX_5CX_2C$ (SEQ ID NO: 117), $CX_6CCXCX_3CXCCX_3CX_4CC$ (SEQ ID NO: 118), $CX_6CCXCX_3CXCX_2CXCX_4CX_5C$ (SEQ ID NO: 119), $CX_4CX_2CCX_3CXCX_4CCX_2CX_3C$ (SEQ ID NO: 120), $CX_3CX_5CX_3CCCX_4CX_9C$ (SEQ ID NO: 121), $CCX_9CX_3CXCCX_3CX_5C$ (SEQ ID NO: 122), $CX_9CX_3CX_3CX_4CCX_4CX_5C$ (SEQ ID NO: 123), $CX_9CX_7CX_4CCXCX_7CX_3C$ (SEQ ID NO: 124), $CX_9CX_3CCCX_{10}CX_2CX_3C$ (SEQ ID NO: 125), $CX_3CX_5CXCX_4CCX_{10}CX_6C$ (SEQ ID NO: 126), $CX_9CX_5CX_4CCXCX_5CX_4C$ (SEQ ID NO: 127), $CX_7CXCX_6CX_4CCCX_{10}C$ (SEQ ID NO: 128), $CX_5CX_2CX_4CCX_4CX_3CX_3C$ (SEQ ID NO: 129), $CX_7CX_5CXCX_4CCX_7CX_4C$ (SEQ ID NO: 130), $CX_{11}CX_3CX_4CCCX_5CX_2C$ (SEQ ID NO: 131), $CX_2CX_3CX_4CCX_4CX_5CX_{15}C$ (SEQ ID NO: 132), $CX_9CX_5CX_4CCX_7C$ (SEQ ID NO: 133), $CX_9CX_7CX_3CX_2CX_6C$ (SEQ ID NO: 134), $CX_9CX_5CX_4CCX_{14}C$ (SEQ ID NO: 135), $CX_9CX_5CX_4CCX_8C$ (SEQ ID NO: 136), $CX_9CX_6CX_4CCXC$ (SEQ ID NO: 137), $CX_5CCX_7CX_4CX_{12}$ (SEQ ID NO: 138), $CX_{10}CX_3CX_4CCX_4C$ (SEQ ID NO: 139), $CX_9CX_4CCX_5CX_4C$ (SEQ ID NO: 140), $CX_{10}CX_3CX_4CX_7CXC$ (SEQ ID NO: 141), $CX_7CX_7CX_2CX_2CX_3C$ (SEQ ID NO: 142), $CX_9CX_4CX_4CCX_6C$ (SEQ ID NO: 143), $CX_7CXCX_3CXCX_6C$ (SEQ ID NO: 144), $CX_7CXCX_4CXCX_4C$ (SEQ ID NO: 145), $CX_9CX_5CX_4C$ (SEQ ID NO: 146), $CX_3CX_6CX_8C$ (SEQ ID NO: 147), $CX_{10}CXCX_4C$ (SEQ ID NO: 148), $CX_{10}CCX_4C$ (SEQ ID NO: 149), $CX_{15}C$ (SEQ ID NO: 150), $CX_{10}C$ (SEQ ID NO: 151), and $CX_9C$ (SEQ ID NO: 152).

In some embodiments of each or any of the above or below mentioned embodiments, the ultralong CDR3 comprises 2 to 6 disulfide bonds.

In some embodiments of each or any of the above or below mentioned embodiments, the ultralong CDR3 comprises SEQ ID NO: 40 or a derivative thereof.

In some embodiments of each or any of the above or below mentioned embodiments, the ultralong CDR3 comprises amino acid residues 3-6 of any of one SEQ ID NO: 1-4.

In some embodiments of each or any of the above or below mentioned embodiments, the ultralong CDR3 comprises a non-human DH or a derivative thereof.

In some embodiments of each or any of the above or below mentioned embodiments, the non-human DH is SEQ ID NO: 5, SEQ ID NO: 6, SEQ ID NO: 7, SEQ ID NO: 8, SEQ ID NO: 9, SEQ ID NO: 10, SEQ ID NO: 11, or SEQ ID NO: 12.

In some embodiments of each or any of the above or below mentioned embodiments, the ultralong CDR3 comprises a JH sequence or a derivative thereof.

In some embodiments of each or any of the above or below mentioned embodiments, the JH sequence comprises amino acids at positions 5-15 of SEQ ID NO: 13, SEQ ID NO: 14, SEQ ID NO: 15, SEQ ID NO: 16, or SEQ ID NO: 17.

In some embodiments of each or any of the above or below mentioned embodiments, the ultralong CDR3 comprises: a sequence derived from a non-human or human VH sequence (e.g., a germline VH) or a derivative thereof; a sequence derived from a non-human DH sequence or a derivative thereof; and/or a sequence derived from a JH sequence or derivative thereof.

In some embodiments of each or any of the above or below mentioned embodiments, the ultralong CDR3 comprises an additional amino acid sequence comprising two to six amino acid residues or more positioned between the VH sequence and the DH sequence.

In some embodiments of each or any of the above or below mentioned embodiments, the additional amino acid sequence is selected from the group consisting of: IR, IF, SEQ ID NO: 18, SEQ ID NO: 19, SEQ ID NO: 20 or SEQ ID NO: 21.

In some embodiments of each or any of the above or below mentioned embodiments, the ultralong CDR3 comprises a sequence derived from or based on SEQ ID NO: 22, SEQ ID NO: 23, SEQ ID NO: 24, SEQ ID NO: 25, SEQ ID NO: 26, SEQ ID NO: 27, or SEQ ID NO: 28.

In some embodiments of each or any of the above or below mentioned embodiments, the ultralong CDR3 comprises a bovine sequence, a non-bovine sequence, an antibody sequence, or a non-antibody sequence.

In some embodiments of each or any of the above or below mentioned embodiments, the non-antibody sequence is a synthetic sequence.

In some embodiments of each or any of the above or below mentioned embodiments, the non-antibody sequence is a cytokine sequence, a lymphokine sequence, a chemokine sequence, a growth factor sequence, a hormone sequence, or a toxin sequence.

In some embodiments of each or any of the above or below mentioned embodiments, the non-antibody sequence is an IL-8 sequence, an IL-21 sequence, an IL-1 sequence, an IL-2 sequence, an IL-4 sequence, an IL-10 sequence, an IL-17 sequence, an GLP-1 sequence, an SDF-1 (alpha) sequence, a somatostatin sequence, a chlorotoxin sequence, a Pro-TxII sequence, a ziconotide sequence, an ADWX-1 sequence, an HsTx1 sequence, an OSK1 sequence, a Pi2 sequence, a Hongotoxin (HgTX) sequence, a Margatoxin sequence, an Agitoxin-2 sequence, a Pi3 sequence, a Kaliotoxin sequence, an Anuroctoxin sequence, a Charybdotoxin sequence, a Tityustoxin-K-alpha sequence, a Maurotoxin sequence, a Ceratotoxin 1 (CcoTx1) sequence, a CcoTx2 sequence, a CcoTx3 sequence, a Phrixotoxin 3 (PaurTx3) sequence, a Hanatoxin 1 sequence, a Phrixotoxin 1 sequence, a Huwentoxin-IV sequence, an α-conotoxin ImI sequence, an α-conotoxin EpI sequence, an α-conotoxin PnIA sequence, an α-conotoxin PnIB sequence, an α-conotoxin MII sequence, an α-conotoxin AuIA sequence, an α-conotoxin AuIB sequence, an α-conotoxin AuIC sequence, a conotoxin κ-PVIIA sequence, a charybdotoxin sequence, a neurotoxin B-IV sequence, a crotamine sequence, a ω-GVIA (conotoxin) sequence, a κ-hefutoxin 1 sequence, a Css4 sequence, a Bj-xtrIT sequence, a BcIV sequence, a Hm-1 sequence, a Hm-2 sequence, a GsAF-I (β-theraphotoxin-Gr1b) sequence, a Protoxin I (ProTx-I sequence, a β-theraphotoxin-Tp1a) sequence, a Protoxin II (ProTx II) sequence, a Huwentoxin I sequence, a μ-Conotoxin PIIIA sequence, a Jingzhaotoxin-III (β-TRTX-Cj1α) sequence, a GsAF-II (Kappa-theraphotoxin-Gr2c) sequence, a ShK (Stichodactyla toxin) sequence, a HsTx1 sequence, a Guangxitoxin 1E (GxTx-1E) sequence, a Maurotoxin sequence, a Charybdotoxin (ChTX) sequence, an Iberiotoxin (IbTx) sequence, a Leiurotoxin 1 (scyllatoxin) sequence, a Tamapin sequence, a Kaliotoxin-1 (KTX) sequence, a Purotoxin 1 (PT-1) sequence, or a GpTx-1 sequence, a MOKA Toxin sequence, a OSK1 (P12, K16, D20) sequence, a OSK1 (K16, D20) sequence, a HmK sequence, a ShK (K16,Y26, K29) sequence, a ShK (K16) sequence, a ShK-A (K16) sequence, a ShK (K16,E30) sequence, a ShK (Q21) sequence, a ShK (L21) sequence, a ShK (F21) sequence, a ShK (I21) sequence, or a ShK (A21) sequence.

In some embodiments of each or any of the above or below mentioned embodiments, the non-antibody sequence is any one of SEQ ID NOS: 475-481, 599-655, 666-698, 727-733, 808-810 and 831-835.

In some embodiments of each or any of the above or below mentioned embodiments, the humanized antibody or binding fragment thereof comprises an antibody heavy chain variable region comprising an amino acid sequence selected from the group consisting of SEQ ID NO: 770-779, 784-791, 903-922 and 925-955.

In some embodiments of each or any of the above or below mentioned embodiments, the humanized antibody or binding fragment thereof comprises a light chain variable region comprising an amino acid sequence SEQ ID NO: 780 or 807.

In some embodiments of each or any of the above or below mentioned embodiments, the humanized antibody or binding fragment thereof comprises an antibody heavy chain variable region comprising an amino acid sequence selected from the group consisting of SEQ ID NO: 770-779, 784-791, 903-922 and 925-955.

In some embodiments of each or any of the above or below mentioned embodiments, the humanized antibody or binding fragment thereof comprises a light chain variable region comprising an amino acid sequence of SEQ ID NO: 956 or 959.

In some embodiments of each or any of the above or below mentioned embodiments, the humanized antibody or binding fragment thereof comprises a heavy chain variable region and a light chain variable region, wherein the antibody heavy chain variable region comprises an amino acid sequence selected from the group consisting of SEQ ID NO: 770-779, 784-791, 903-922 and 925-955, and the light chain variable region comprising the amino acid sequence of SEQ ID NO: 959. In some aspects, the antibody heavy chain variable region comprises the amino acid sequence of SEQ ID NO: 941, and the light chain variable region comprising the amino acid sequence of SEQ ID NO: 959.

In some embodiments of each or any of the above or below mentioned embodiments, the humanized antibody or binding fragment thereof comprises a heavy chain variable region and a light chain variable region, wherein the antibody heavy chain variable region comprises an amino acid sequence selected from the group consisting of SEQ ID NO: 770-779, 784-791, 903-922 and 925-955, and wherein the light chain variable region comprising the amino acid sequence of SEQ ID NO: 956.

In some embodiments of each or any of the above or below mentioned embodiments, the non-antibody sequence replaces at least a portion of the ultralong CDR3.

In some embodiments of each or any of the above or below mentioned embodiments, the non-antibody sequence (e.g., a non-antibody human sequence) is inserted into the CDR3, including optionally, wherein a portion of CDR3 (e.g., one or more amino acids of the CDR3) or the entire CDR3 sequence (e.g., all or substantially all of the amino acids of the CDR3) is removed.

In some embodiments of each or any of the above or below mentioned embodiments, the ultralong CDR3 comprises a $X^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q).

In some embodiments of each or any of the above or below mentioned embodiments, the $X^1X^2X^3X^4X^5$ motif is TTVHQ (SEQ ID NO: 153), TSVHQ (SEQ ID NO: 154), SSVTQ (SEQ ID NO: 155), STVHQ (SEQ ID NO: 156), ATVRQ (SEQ ID NO: 157), TTVYQ (SEQ ID NO: 158), SPVHQ (SEQ ID NO: 159), ATVYQ (SEQ ID NO: 160), TAVYQ (SEQ ID NO: 161), TNVHQ (SEQ ID NO: 162), ATVHQ (SEQ ID NO: 163), STVYQ (SEQ ID NO: 164), TIVHQ (SEQ ID NO: 165), AIVYQ (SEQ ID NO: 166), TTVFQ (SEQ ID NO: 167), AAVFQ (SEQ ID NO: 168), GTVHQ (SEQ ID NO: 169), ASVHQ (SEQ ID NO: 170), TAVFQ (SEQ ID NO: 171), ATVFQ (SEQ ID NO: 172), AAAHQ (SEQ ID NO: 173), VVVYQ (SEQ ID NO: 174), GTVFQ (SEQ ID NO: 175), TAVHQ (SEQ ID NO: 176), ITVHQ (SEQ ID NO: 177), ITAHQ (SEQ ID NO: 178), VTVHQ (SEQ ID NO: 179); AAVHQ (SEQ ID NO: 180), GTVYQ (SEQ ID NO: 181), TTVLQ (SEQ ID NO: 182), TTTHQ (SEQ ID NO: 183), or TTDYQ (SEQ ID NO: 184).

In some embodiments of each or any of the above or below mentioned embodiments, the ultralong CDR3 comprises a $CX^1X^2X^3X^4X^5$ motif.

In some embodiments of each or any of the above or below mentioned embodiments, the $CX^1X^2X^3X^4X^5$ motif is CTTVHQ (SEQ ID NO: 185), CTSVHQ (SEQ ID NO: 186), CSSVTQ (SEQ ID NO: 187), CSTVHQ (SEQ ID NO: 188), CATVRQ (SEQ ID NO: 189), CTTVYQ (SEQ ID NO: 190), CSPVHQ (SEQ ID NO: 191), CATVYQ (SEQ ID NO: 192), CTAVYQ (SEQ ID NO: 193), CTNVHQ (SEQ ID NO: 194), CATVHQ (SEQ ID NO: 195), CSTVYQ (SEQ ID NO: 196), CTIVHQ (SEQ ID NO: 197), CAIVYQ (SEQ ID NO: 198), CTTVFQ (SEQ ID NO: 199), CAAVFQ (SEQ ID NO: 200), CGTVHQ (SEQ ID NO: 201), CASVHQ (SEQ ID NO: 202), CTAVFQ (SEQ ID NO: 203), CATVFQ (SEQ ID NO: 204), CAAAHQ (SEQ ID NO: 205), CVVVYQ (SEQ ID NO: 206), CGTVFQ (SEQ ID NO: 207), CTAVHQ (SEQ ID NO: 208), CITVHQ (SEQ ID NO: 209), CITAHQ (SEQ ID NO: 210), CVTVHQ (SEQ ID NO: 211); CAAVHQ (SEQ ID NO: 212), CGTVYQ (SEQ ID NO: 213), CTTVLQ (SEQ ID NO: 214), CTTTHQ (SEQ ID NO: 215), or CTTDYQ (SEQ ID NO: 216).

In some embodiments of each or any of the above or below mentioned embodiments, the ultralong CDR3 comprises a $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the $(X^aX^b)_z$ motif is CYTYNYEF (SEQ ID NO: 217), HYTYTYDF (SEQ ID NO: 218), HYTYTYEW (SEQ ID NO: 219), KHRYTYEW (SEQ ID NO: 220), NYIYKYSF (SEQ ID NO: 221), PYIYTYQF (SEQ ID NO: 222), SFTYTYEW (SEQ ID NO: 223), SYIYIYQW (SEQ ID NO: 224), SYNYTYSW (SEQ ID NO: 225), SYSYSYEY (SEQ ID NO: 226), SYTYNYDF (SEQ ID NO: 227), SYTYNYEW (SEQ ID NO: 228), SYTYNYQF (SEQ ID NO: 229), SYVWTHNF (SEQ ID NO: 230), TYKYVYEW (SEQ ID NO: 231), TYTYTYEF (SEQ ID NO: 232), TYTYTYEW (SEQ ID NO: 233), VFTYTYEF (SEQ ID NO: 234), AYTYEW (SEQ ID NO: 235), DYIYTY (SEQ ID NO: 236), IHSYEF (SEQ ID NO: 237), SFTYEF (SEQ ID NO: 238), SHSYEF (SEQ ID NO: 239), THTYEF (SEQ ID NO: 240), TWTYEF (SEQ ID NO: 241), TYNYEW (SEQ ID NO: 242), TYSYEF (SEQ ID NO: 243), TYSYEH (SEQ ID NO: 244), TYTYDF (SEQ ID NO: 245), TYTYEF (SEQ ID NO: 246), TYTYEW (SEQ ID NO: 247), AYEF (SEQ ID NO: 248), AYSF (SEQ ID NO: 249), AYSY (SEQ ID NO: 250), CYSF (SEQ ID NO: 251), DYTY (SEQ ID NO: 252), KYEH (SEQ ID NO: 253), KYEW (SEQ ID NO: 254), MYEF (SEQ ID NO: 255), NWIY (SEQ ID NO: 256), NYDY (SEQ ID NO: 257), NYQW (SEQ ID NO: 258), NYSF (SEQ ID NO: 259), PYEW (SEQ ID NO: 260), RYNW (SEQ ID NO: 261), RYTY (SEQ ID NO: 262), SYEF (SEQ ID NO: 263), SYEH (SEQ ID NO: 264), SYEW (SEQ ID NO: 265), SYKW (SEQ ID NO: 266), SYTY (SEQ ID NO: 267), TYDF (SEQ ID NO: 268), TYEF (SEQ ID NO: 269), TYEW (SEQ ID NO: 270), TYQW (SEQ ID NO: 271), TYTY (SEQ ID NO: 272), or VYEW (SEQ ID NO: 273).

In some embodiments of each or any of the above or below mentioned embodiments, the $(X^aX^b)_z$ motif is YXYXYX.

In some embodiments of each or any of the above or below mentioned embodiments, the ultralong CDR3 comprises a $X^1X^2X^3X^4X^5X_n$ motif, wherein $X_1$ is threonine (T), glycine (G), alanine (A), serine (S), or valine (V), wherein $X_2$ is serine (S), threonine (T), proline (P), isoleucine (I), alanine (A), valine (V), or asparagine (N), wherein $X_3$ is valine (V), alanine (A), threonine (T), or aspartic acid (D), wherein $X_4$ is histidine (H), threonine (T), arginine (R), tyrosine (Y), phenylalanine (F), or leucine (L), wherein $X_5$ is glutamine (Q), and wherein n is 27-54.

In some embodiments of each or any of the above or below mentioned embodiments, the ultralong CDR3 comprises $X_n(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4.

In some embodiments of each or any of the above or below mentioned embodiments, the ultralong CDR3 comprises a $X^1X^2X^3X^4X^5X_n(X^aX^b)_z$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q), wherein $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4.

In some embodiments of each or any of the above or below mentioned embodiments, the $X^1X^2X^3X^4X^5$ motif is TTVHQ (SEQ ID NO: 153) or TSVHQ (SEQ ID NO: 154), and wherein the $(X^aX^b)_z$ motif is YXYXYX.

In some embodiments of each or any of the above or below mentioned embodiments, the ultralong CDR3 comprises: a $CX^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q); a cysteine motif selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_8C$ (SEQ ID NO: 46), $CX_{10}CX_6CX_6CXCX_7C$ (SEQ ID NO: 47), $CX_{10}CX_4CX_7CXCX_8C$ (SEQ ID NO: 48), $CX_{10}CX_4CX_7CXCX_7C$ (SEQ ID NO: 49), $CX_{13}CX_8CX_8C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CX_5CXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_5CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CX_5CX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CXCX_7CXCX_6C$ (SEQ ID NO: 76), $CX_{10}CX_4CX_5CX_{12}C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_5CX_6C$ (SEQ ID NO: 82), $CX_{12}CX_4CX_5CX_5CX_2C$ (SEQ ID NO: 83), $CX_{12}CX_5CX_5CXCX_8C$ (SEQ ID NO: 84), $CX_{10}CX_6CX_5CXCX_4CXCX_9C$ (SEQ ID NO: 85), $CX_{11}CX_4CX_5CX_8CX_2C$ (SEQ ID NO: 86), $CX_{10}CX_6CX_5CX_8CX_2C$ (SEQ ID NO: 87), $CX_{10}CX_6CX_5CXCX_8C$ (SEQ ID NO: 88), $CX_{10}CX_6CX_5CXCX_3CX_8CX_2C$ (SEQ ID NO: 89), $CX_{10}CX_6CX_5CX_3CX_8C$ (SEQ ID NO: 90), $CX_{10}CX_6CX_5CXCX_2CX_6CX_5C$ (SEQ ID NO: 91), $CX_7CX_6CX_3CX_3CX_9C$ (SEQ ID NO: 92), $CX_9CX_8CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95), and a $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the ultralong CDR3 comprises: a $CX^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q); a cysteine motif selected from the group consisting of: wherein the cysteine motif is selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_9CX_3CXCX_2CXCCCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_8CX_5CX_4CX_3CX_4CCXCX_1C$ (SEQ ID NO: 103), $CCX_6CCX_5CCCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCXCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_3CX_3C$ (SEQ ID NO: 112), $CX_8CCXCX_3CCX_3CXCX_3CX_4C$ (SEQ ID NO: 113), $CX_9CCX_4CX_2CXCCXCX_4CX_3C$ (SEQ ID NO: 114), $CX_{10}CXCX_3CX_2CXCCX_4CX_5CXC$ (SEQ ID NO: 115), $CX_9CXCX_3CX_2CXCCX_4CX_5CXC$ (SEQ ID NO: 116), $CX_6CCXCX_5CX_4CCXCX_5CX_2C$ (SEQ ID NO: 117), $CX_6CCXCX_3CXCCX_3CX_4CC$ (SEQ ID NO: 118), $CX_6CCXCX_3CXCX_2CXCX_4CX_8C$ (SEQ ID NO: 119), $CX_4CX_2CCX_3CXCX_4CCX_2CX_3C$ (SEQ ID NO: 120), $CX_3CX_5CX_3CCCX_4CX_9C$ (SEQ ID NO: 121), $CCX_9CX_3CXCCX_3CX_5C$ (SEQ ID NO: 122), $CX_9CX_2CX_3CX_4CCX_4CX_5C$ (SEQ ID NO: 123), $CX_9CX_7CX_4CCXCX_7CX_3C$ (SEQ ID NO: 124), $CX_9CX_3CCCX_{10}CX_2CX_3C$ (SEQ ID NO: 125), $CX_3CX_5CX_5CX_4CCX_{10}CX_6C$ (SEQ ID NO: 126), $CX_9CX_5CX_4CCXCX_5CX_4C$ (SEQ ID NO: 127), $CX_7CXCX_6CX_4CCCX_{10}C$ (SEQ ID NO: 128), $CX_8CX_2CX_4CCX_4CX_3CX_3C$ (SEQ ID NO: 129), $CX_7CX_5CXCX_4CCX_7CX_4C$ (SEQ ID NO: 130), $CX_{11}CX_3CX_4CCCX_8CX_2C$ (SEQ ID NO: 131), $CX_2CX_3CX_4CCX_4CX_5CX_{15}C$ (SEQ ID NO: 132), $CX_9CX_5CX_4CCX_7C$ (SEQ ID NO: 133), $CX_9CX_7CX_3CX_2CX_6C$ (SEQ ID NO: 134), $CX_9CX_5CX_4CCX_{14}C$ (SEQ ID NO: 135), $CX_9CX_5CX_4CCX_8C$ (SEQ ID NO: 136), $CX_9CX_6CX_4CCXC$ (SEQ ID NO: 137), $CX_5CCX_7CX_4CX_{12}$ (SEQ ID NO: 138), $CX_{10}CX_3CX_4CCX_4C$ (SEQ ID NO: 139), $CX_9CX_4CCX_5CX_4C$ (SEQ ID NO: 140), $CX_{10}CX_3CX_4CX_7CXC$ (SEQ ID NO: 141), $CX_7CX_7CX_2CX_2CX_3C$ (SEQ ID NO: 142), $CX_9CX_4CX_4CCX_6C$ (SEQ ID NO: 143), $CX_7CXCX_3CXCX_6C$ (SEQ ID NO: 144), $CX_7CXCX_4CXCX_4C$ (SEQ ID NO: 145), $CX_9CX_5CX_4C$ (SEQ ID NO: 146), $CX_3CX_6CX_8C$ (SEQ ID NO: 147), $CX_{10}CXCX_4C$ (SEQ ID NO: 148), $CX_{10}CCX_4C$ (SEQ ID NO: 149), $CX_{15}C$ (SEQ ID NO: 150), $CX_{10}C$ (SEQ ID NO: 151), and $CX_9C$ (SEQ ID NO: 152); and a $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the ultralong CDR3 comprises an additional sequence that is a linker.

In some embodiments of each or any of the above or below mentioned embodiments, the linker is linked to a C-terminus, a N-terminus, or both C-terminus and N-terminus of the non-antibody sequence.

In some embodiments of each or any of the above or below mentioned embodiments, the ultralong CDR3 is a ruminant CDR3.

In some embodiments of each or any of the above or below mentioned embodiments, the ruminant is a cow.

In some embodiments of each or any of the above or below mentioned embodiments, the humanized antibody or binding fragment thereof comprises a human heavy chain variable region framework sequence.

In some embodiments of each or any of the above or below mentioned embodiments, the humanized antibody or binding fragment thereof comprises a human heavy chain germline sequence or is a derived from a human heavy chain germline sequence.

In some embodiments of each or any of the above or below mentioned embodiments, the heavy chain variable region comprises an amino acid sequence of SEQ ID NO: 735.

In some embodiments of each or any of the above or below mentioned embodiments, the heavy chain variable region comprises an amino acid sequence of SEQ ID NO: 737.

In some embodiments of each or any of the above or below mentioned embodiments, the heavy chain variable region comprises an amino acid sequence of SEQ ID NO: 739.

In some embodiments of each or any of the above or below mentioned embodiments, the heavy chain variable region comprises an amino acid sequence of SEQ ID NO: 741.

In some embodiments of each or any of the above or below mentioned embodiments, the heavy chain variable region comprises an amino acid sequence of SEQ ID NO: 743.

In some embodiments of each or any of the above or below mentioned embodiments, the heavy chain variable region comprises an amino acid sequence of SEQ ID NO: 745.

In some embodiments of each or any of the above or below mentioned embodiments, the heavy chain variable region comprises an amino acid sequence of SEQ ID NO: 747.

In some embodiments of each or any of the above or below mentioned embodiments, the heavy chain variable region comprises an amino acid sequence of SEQ ID NO: 749.

In some embodiments of each or any of the above or below mentioned embodiments, the ultralong CDR3 comprises an amino acid sequence of: (i) any one of GSKHRLRDYFLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507); (ii) any one of EAGGPDYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515); (iii) any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523); (iv) any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529); (v) any one of DKGDSDYDYNL (SEQ ID NO: 530), DKGDSDYDYN (SEQ ID NO: 531), DKGDSDYDY (SEQ ID NO: 532), DKGDSDYD (SEQ ID NO: 533), DKGDSDY (SEQ ID NO: 534), DKGDSD (SEQ ID NO: 535); (vi) TSVHQETKKYQS (SEQ ID NO: 498).

In some embodiments of each or any of the above or below mentioned embodiments, the ultralong CDR3 comprises an amino acid sequence of: (i) any one of YGPNYEEWGDYLATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541); (ii) any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548); (iii) any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNYHYMDV (SEQ ID NO: 553), or GYYNYHYMDV (SEQ ID NO: 554); (iv) any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563); (v) any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569); or (vi) SYTYNYEWHVDV (SEQ ID NO: 499).

In some embodiments of each or any of the above or below mentioned embodiments, the ultralong CDR3 comprises an amino acid sequence of: (i) any one of GSKHRLRDYFLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507), and any one of YGPNYEEWGDYLATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541); (ii) any one of EAGGPDYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515), and any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548); (iii) any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523), and any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNYHYMDV (SEQ ID NO: 553), or GYYNYHYMDV (SEQ ID NO: 554); (iv) any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529), and any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563); (v) any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), and any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569); or (vi) TSVHQETKKYQS (SEQ ID NO: 498) and SYTYNYEWHVDV (SEQ ID NO: 499).

In some embodiments of each or any of the above or below mentioned embodiments, the humanized antibody or binding fragment thereof comprises a human light chain variable region framework sequence.

In some embodiments of each or any of the above or below mentioned embodiments, the humanized antibody or binding fragment thereof comprises a light chain variable region comprising a sequence selected from the group of: (i)

SEQ ID NO: 750, (ii) SEQ ID NO: 751, (iii) SEQ ID NO: 752, and (iv) SEQ ID NO: 753.

In some embodiments of each or any of the above or below mentioned embodiments, the light chain variable comprises a lambda light chain variable region sequence or derived from a lambda light chain variable region sequence.

In some embodiments of each or any of the above or below mentioned embodiments, the light chain variable region sequence comprises a human lambda light chain variable region sequence or derived from a human lambda light chain variable region sequence.

In some embodiments of each or any of the above or below mentioned embodiments, the light chain variable region comprises a VL1-51 germline sequence.

In some embodiments of each or any of the above or below mentioned embodiments, the light chain variable region is derived from a VL1-51 germline sequence.

In some embodiments of each or any of the above or below mentioned embodiments, the VL1-51 germline sequence comprises a CDR1 comprising Ile29Val and Asn32Gly substitution based on Kabat numbering.

In some embodiments of each or any of the above or below mentioned embodiments, the VL1-51 germline sequence comprises a CDR2 comprising a substitution of DNN to GDT.

In some embodiments of each or any of the above or below mentioned embodiments, the VL1-51 germline sequence comprises a CDR2 comprising a substitution of DNNKRP (SEQ ID NO: 471) to GDTSRA (SEQ ID NO: 472).

In some embodiments of each or any of the above or below mentioned embodiments, the VL1-51 germline sequence comprises a S2A, T5N, P8S, A12G, A13S, and P14L substitution based on Kabat numbering.

In some embodiments of each or any of the above or below mentioned embodiments, the VL1-51 germline sequence comprises a S2A, T5N, P8S, A12G, A13S, and P14L substitution based on Kabat numbering, and a CDR2 comprising a substitution of DNN to GDT.

In some embodiments of each or any of the above or below mentioned embodiments, the humanized antibody or binding fragment thereof comprising: (a) a heavy chain variable region comprising a sequence selected from the group consisting of SEQ ID NO: 740, SEQ ID NO: 741, SEQ ID NO:742, and SEQ ID NO: 743; and (b) a light chain variable region comprising SEQ ID NO: 750.

The present disclosure also provides polynucleotides encoding the heavy chain variable region of the humanized antibody or binding fragment thereof disclosed herein.

The present disclosure also provides polynucleotides encoding the light chain variable region of the humanized antibody or binding fragment thereof disclosed herein.

The present disclosure also provides polynucleotides encoding a heavy chain variable region that comprises an ultralong CDR3, wherein the polynucleotide comprises a sequence selected from the group consisting of SEQ ID NO: 490, SEQ ID NO: 491, SEQ ID NO: 492, SEQ ID NO: 493, SEQ ID NO: 494, SEQ ID NO: 495, SEQ ID NO: 496, and SEQ ID NO: 497.

The present disclosure also provides vectors that comprise the polynucleotides disclosed herein.

The present disclosure also provides host cells comprising the vectors disclosed herein.

The present disclosure also provides a nucleic acid library comprising a plurality of polynucleotides comprising sequences coding for humanized antibodies or binding fragments thereof, wherein the antibodies or binding fragments thereof comprise a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3.

The present disclosure also provides a library of humanized antibodies or binding fragments thereof, wherein the antibodies or binding fragments thereof comprise (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3.

In some embodiments of each or any of the above or below mentioned embodiments, the ultralong CDR3 is 35 amino acids in length or longer, 40 amino acids in length or longer, 45 amino acids in length or longer, 50 amino acids in length or longer, 55 amino acids in length or longer, or 60 amino acids in length or longer.

In some embodiments of each or any of the above or below mentioned embodiments, the ultralong CDR3 is 35 amino acids in length or longer.

In some embodiments of each or any of the above or below mentioned embodiments, the ultralong CDR3 comprises 3 or more cysteine residues, 4 or more cysteine residues, 5 or more cysteine residues, 6 or more cysteine residues, 7 or more cysteine residues, 8 or more cysteine residues, 9 or more cysteine residues, 10 or more cysteine residues, 11 or more cysteine residues, or 12 or more cysteine residues.

In some embodiments of each or any of the above or below mentioned embodiments, the ultralong CDR3 comprises 3 or more cysteine residues.

In some embodiments of each or any of the above or below mentioned embodiments, the antibodies or binding fragments thereof comprise a cysteine motif.

In some embodiments of each or any of the above or below mentioned embodiments, the cysteine motif is selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_5C$ (SEQ ID NO: 46), $CX_{10}CX_6CX_6CXCX_7C$ (SEQ ID NO: 47), $CX_{10}CX_4CX_7CXCXC$ (SEQ ID NO: 48), $CX_{10}CX_4CX_7CXCX_7C$ (SEQ ID NO: 49), $CX_{13}CX_8CX_8C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CX_5CXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_8CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CX_5CX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CX_5CX_7CXCX_6C$ (SEQ ID NO: 76), $CX_{10}CX_4CX_5CX_{12}CX_2C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_8CX_6C$ (SEQ ID NO: 82), $CX_{12}CX_4CX_5CX_8CX_2C$ (SEQ ID NO: 83), $CX_{12}CX_5CX_5CXCX_8C$ (SEQ ID NO: 84), $CX_{10}CX_6CX_5CXCX_4CXCX_9C$ (SEQ ID NO: 85), $CX_{11}CX_4CX_5CX_8CX_2C$ (SEQ ID NO: 86), $CX_{10}CX_6CX_5CX_8CX_2C$ (SEQ ID NO: 87), $CX_{10}CX_6CX_5CXCX_8C$ (SEQ ID NO: 88), $CX_{10}CX_6CX_5CXCX_3CXCX_2C$ (SEQ ID NO: 89), $CX_{10}CX_6CX_5CX_3CX_8C$ (SEQ ID NO: 90), $CX_{10}CX_6CX_5CXCX_2CX_6CXC$ (SEQ ID NO: 91), $CX_7CX_6CX_3CX_3CX_9C$ (SEQ ID NO: 92), $CX_9CX_8CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95).

In some embodiments of each or any of the above or below mentioned embodiments, the cysteine motif is selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_9CX_3CXCX_2CXCCCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_5CX_5CX_4CX_3CX_4CCXCX_1C$ (SEQ ID NO: 103), $CCX_6CCX_5CCCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCXCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_3CX_3C$ (SEQ ID NO: 112), $CX_8CCXCX_3CCX_3CXCX_3CX_4C$ (SEQ ID NO: 113), $CX_9CCX_4CX_2CXCCXCX_4CX_3C$ (SEQ ID NO: 114), $CX_{10}CXCX_3CX_2CXCCX_4CX_5CXC$ (SEQ ID NO: 115), $CX_9CXCX_3CX_2CXCCX_4CXCXC$ (SEQ ID NO: 116), $CX_6CCXCX_5CX_4CCXCX_5CX_2C$ (SEQ ID NO: 117), $CX_6CCXCX_5CXCCX_3CX_4CC$ (SEQ ID NO: 118), $CX_6CCXCX_3CXCX_2CXCX_4CX_8C$ (SEQ ID NO: 119), $CX_4CX_2CCX_3CXCX_4CCX_2CX_3C$ (SEQ ID NO: 120), $CX_3CX_5CX_3CCCX_4CX_9C$ (SEQ ID NO: 121), $CCX_9CX_3CXCCX_3CX_5C$ (SEQ ID NO: 122), $CX_9CX_2CX_3CX_4CCX_4CX_5C$ (SEQ ID NO: 123), $CX_9CX_7CX_4CCXCX_7CX_3C$ (SEQ ID NO: 124), $CX_9CX_3CCCX_{10}CX_2CX_3C$ (SEQ ID NO: 125), $CX_3CX_5CX_5CX_4CCX_{10}CX_6C$ (SEQ ID NO: 126), $CX_9CX_5CX_4CCXCX_5CX_4C$ (SEQ ID NO: 127), $CX_7CXCX_6CX_4CCCX_{10}C$ (SEQ ID NO: 128), $CX_8CX_2CX_4CCX_4CX_3CX_3C$ (SEQ ID NO: 129), $CX_7CX_5CXCX_4CCX_7CX_4C$ (SEQ ID NO: 130), $CX_{11}CX_3CX_4CCCX_8CX_2C$ (SEQ ID NO: 131), $CX_2CX_3CX_4CCX_4CX_5CX_{15}C$ (SEQ ID NO: 132), $CX_9CX_5CX_4CCX_7C$ (SEQ ID NO: 133), $CX_9CX_7CX_3CX_2CX_6C$ (SEQ ID NO: 134), $CX_9CX_5CX_4CCX_{14}C$ (SEQ ID NO: 135), $CX_9CX_5CX_4CCX_8C$ (SEQ ID NO: 136), $CX_9CX_6CX_4CCXC$ (SEQ ID NO: 137), $CX_5CCX_7CX_4CX_{12}$ (SEQ ID NO: 138), $CX_{10}CX_3CX_4CCX_4C$ (SEQ ID NO: 139), $CX_9CX_4CCX_5CX_4C$ (SEQ ID NO: 140), $CX_{10}CX_3CX_4CX_7CXC$ (SEQ ID NO: 141), $CX_7CX_7CX_2CX_2CX_3C$ (SEQ ID NO: 142), $CX_9CX_4CX_4CCX_6C$ (SEQ ID NO: 143), $CX_7CXCX_3CXCX_6C$ (SEQ ID NO: 144), $CX_7CXCX_4CXCX_4C$ (SEQ ID NO: 145), $CX_9CX_5CX_4C$ (SEQ ID NO: 146), $CX_3CX_6CXC$ (SEQ ID NO: 147), $CX_{10}CXCX_4C$ (SEQ ID NO: 148), $CX_{10}CCX_4C$ (SEQ ID NO: 149), $CX_{15}C$ (SEQ ID NO: 150), $CX_{10}C$ (SEQ ID NO: 151), and $CX_9C$ (SEQ ID NO: 152).

In some embodiments of each or any of the above or below mentioned embodiments, the ultralong CDR3 comprises 2 to 6 disulfide bonds.

In some embodiments of each or any of the above or below mentioned embodiments, the ultralong CDR3 comprises SEQ ID NO: 40 or a derivative thereof.

In some embodiments of each or any of the above or below mentioned embodiments, the ultralong CDR3 comprises amino acid residues 3-6 of any of one SEQ ID NO: 1-4.

In some embodiments of each or any of the above or below mentioned embodiments, the ultralong CDR3 comprises a non-human DH or a derivative thereof.

In some embodiments of each or any of the above or below mentioned embodiments, the non-human DH is SEQ ID NO: 5, SEQ ID NO: 6, SEQ ID NO: 7, SEQ ID NO: 8, SEQ ID NO: 9, SEQ ID NO: 10, SEQ ID NO: 11, or SEQ ID NO: 12.

In some embodiments of each or any of the above or below mentioned embodiments, the ultralong CDR3 comprises a JH sequence or a derivative thereof.

In some embodiments of each or any of the above or below mentioned embodiments, the JH sequence comprises amino acids as positions 5-15 of SEQ ID NO: 13, SEQ ID NO: 14, SEQ ID NO: 15, SEQ ID NO: 16, or SEQ ID NO: 17.

In some embodiments of each or any of the above or below mentioned embodiments, the ultralong CDR3 comprises: a sequence derived from a non-human VH sequence or a derivative thereof; a sequence derived from a non-human DH sequence or a derivative thereof; and/or a sequence derived from JH sequence or derivative thereof.

In some embodiments of each or any of the above or below mentioned embodiments, the ultralong CDR3 comprises an additional amino acid sequence comprising two to six amino acid residues or more positioned between the VH sequence and the DH sequence.

In some embodiments of each or any of the above or below mentioned embodiments, the additional amino acid sequence is selected from the group consisting of: IR, IF, SEQ ID NO: 18, SEQ ID NO: 19, SEQ ID NO: 20 or SEQ ID NO: 21.

In some embodiments of each or any of the above or below mentioned embodiments, the ultralong CDR3 comprises a sequence derived from or based on SEQ ID NO: 22, SEQ ID NO: 23, SEQ ID NO: 24, SEQ ID NO: 25, SEQ ID NO: 26, SEQ ID NO: 27, or SEQ ID NO: 28.

In some embodiments of each or any of the above or below mentioned embodiments, the ultralong CDR3 comprises a non-bovine sequence or a non-antibody sequence.

For example, the non-antibody sequence (e.g., a non-antibody human sequence) is inserted into the CDR3, including optionally, wherein a portion of CDR3 (e.g., one or more amino acids of the CDR3) or the entire CDR3 sequence (e.g., all or substantially all of the amino acids of the CDR3) is removed.

In some embodiments of each or any of the above or below mentioned embodiments, the non-antibody sequence is a synthetic sequence.

In some embodiments of each or any of the above or below mentioned embodiments, the non-antibody sequence is a cytokine sequence, a lymphokine sequence, a chemokine sequence, a growth factor sequence, a hormone sequence, or a toxin sequence.

In some embodiments of each or any of the above or below mentioned embodiments, the non-antibody sequence is an IL-8 sequence, an IL-21 sequence, an SDF-1 (alpha) sequence, a somatostatin sequence, a chlorotoxin sequence, a Pro-TxII sequence, a ziconotide sequence, an ADWX-1 sequence, an HsTx1 sequence, an OSK1 sequence, a Pi2 sequence, a Hongotoxin (HgTX) sequence, a Margatoxin sequence, an Agitoxin-2 sequence, a Pi3 sequence, a Kaliotoxin sequence, an Anurocotoxin sequence, a Charybdotoxin sequence, a Tityustoxin-K-alpha sequence, a Maurotoxin sequence, a Ceratotoxin 1 (CcoTx1) sequence, a CcoTx2 sequence, a CcoTx3 sequence, a Phrixotoxin 3 (PaurTx3) sequence, a Hanatoxin 1 sequence, a Phrixotoxin 1 sequence, a Huwentoxin-IV sequence, an α-conotoxin ImI sequence, an α-conotoxin EpI sequence, an α-conotoxin PnIA sequence, an α-conotoxin PnIB sequence, an α-conotoxin MII sequence, an α-conotoxin AuIA sequence, an α-conotoxin AuIB sequence, an α-conotoxin AuIC sequence, a conotoxin κ-PVIIA sequence, a charybdotoxin sequence, a neurotoxin B-IV sequence, a crotamine sequence, a ω-GVIA (conotoxin) sequence, a κ-hefutoxin 1 sequence, a Css4 sequence, a Bj-xtrIT sequence, a BcIV sequence, a Hm-1 sequence, a Hm-2 sequence, a GsAF-I (β-theraphotoxin-Gr1b) sequence, a Protoxin I (ProTx-I sequence, a β-theraphotoxin-Tp1a) sequence, a Protoxin II (ProTx II) sequence, a Huwentoxin I sequence, a μ-Conotoxin PIIIA sequence, a Jingzhaotoxin-III (β-TRTX-Cj1α) sequence, a GsAF-II (Kappa-theraphotoxin-Gr2c) sequence, a ShK (Stichodactyla toxin) sequence, a HsTx1 sequence, a Guangxitoxin 1E (GxTx-1E) sequence, a Maurotoxin sequence, a Charybdotoxin (ChTX) sequence, an Iberiotoxin (IbTx) sequence, a Leiurotoxin 1 (scyllatoxin) sequence, a Tamapin sequence, a Kaliotoxin-1 (KTX) sequence, a Purotoxin1 (PT-1) sequence, or a GpTx-1 sequence, a MOKA Toxin sequence, a OSK1 (P12, K16, D20) sequence, a OSK1 (K16, D20) sequence, a HmK sequence, a ShK (K16,Y26, K29) sequence, a ShK (K16) sequence, a ShK-A (K16) sequence, a ShK (K16,E30) sequence, a ShK (Q21) sequence, a ShK (L21) sequence, a ShK (F21) sequence, a ShK (I21) sequence, or a ShK (A21) sequence.

In some embodiments of each or any of the above or below mentioned embodiments, the non-antibody sequence is any one of SEQ ID NOS: 475-481, 599-655, 666-698, 727-733, 808-810 and 831-835.

In some embodiments of each or any of the above or below mentioned embodiments, the ultralong CDR3 comprises a $X^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q).

In some embodiments of each or any of the above or below mentioned embodiments, the $X^1X^2X^3X^4X^5$ motif is TTVHQ (SEQ ID NO: 153), TSVHQ (SEQ ID NO: 154), SSVTQ (SEQ ID NO: 155), STVHQ (SEQ ID NO: 156), ATVRQ (SEQ ID NO: 157), TTVYQ (SEQ ID NO: 158), SPVHQ (SEQ ID NO: 159), ATVYQ (SEQ ID NO: 160), TAVYQ (SEQ ID NO: 161), TNVHQ (SEQ ID NO: 162), ATVHQ (SEQ ID NO: 163), STVYQ (SEQ ID NO: 164), TIVHQ (SEQ ID NO: 165), AIVYQ (SEQ ID NO: 166), TTVFQ (SEQ ID NO: 167), AAVFQ (SEQ ID NO: 168), GTVHQ (SEQ ID NO: 169), ASVHQ (SEQ ID NO: 170), TAVFQ (SEQ ID NO: 171), ATVFQ (SEQ ID NO: 172), AAAHQ (SEQ ID NO: 173), VVVYQ (SEQ ID NO: 174), GTVFQ (SEQ ID NO: 175), TAVHQ (SEQ ID NO: 176), ITVHQ (SEQ ID NO: 177), ITAHQ (SEQ ID NO: 178), VTVHQ (SEQ ID NO: 179); AAVHQ (SEQ ID NO: 180), GTVYQ (SEQ ID NO: 181), TTVLQ (SEQ ID NO: 182), TTTHQ (SEQ ID NO: 183), or TTDYQ (SEQ ID NO: 184).

In some embodiments of each or any of the above or below mentioned embodiments, the ultralong CDR3 comprises a $CX^1X^2X^3X^4X^5$ motif.

In some embodiments of each or any of the above or below mentioned embodiments, the $CX^1X^2X^3X^4X^5$ motif is CTTVHQ (SEQ ID NO: 185), CTSVHQ (SEQ ID NO: 186), CSSVTQ (SEQ ID NO: 187), CSTVHQ (SEQ ID NO: 188), CATVRQ (SEQ ID NO: 189), CTTVYQ (SEQ ID NO: 190), CSPVHQ (SEQ ID NO: 191), CATVYQ (SEQ ID NO: 192), CTAVYQ (SEQ ID NO: 193), CTNVHQ (SEQ ID NO: 194), CATVHQ (SEQ ID NO: 195), CSTVYQ (SEQ ID NO: 196), CTIVHQ (SEQ ID NO: 197), CAIVYQ (SEQ ID NO: 198), CTTVFQ (SEQ ID NO: 199), CAAVFQ (SEQ ID NO: 200), CGTVHQ (SEQ ID NO: 201), CASVHQ (SEQ ID NO: 202), CTAVFQ (SEQ ID NO: 203), CATVFQ (SEQ ID NO: 204), CAAAHQ (SEQ ID NO: 205), CVVVYQ (SEQ ID NO: 206), CGTVFQ (SEQ ID NO: 207), CTAVHQ (SEQ ID NO: 208), CITVHQ (SEQ ID NO: 209), CITAHQ (SEQ ID NO: 210), CVTVHQ (SEQ ID NO: 211); CAAVHQ (SEQ ID NO: 212), CGTVYQ (SEQ ID NO: 213), CTTVLQ (SEQ ID NO: 214), CTTTHQ (SEQ ID NO: 215), or CTTDYQ (SEQ ID NO: 216).

In some embodiments of each or any of the above or below mentioned embodiments, the ultralong CDR3 comprises a $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the $(X^aX^b)_z$ motif is CYTYNYEF (SEQ ID NO: 217), HYTYTYDF (SEQ ID NO: 218), HYTYTYEW (SEQ ID NO: 219), KHRYTYEW (SEQ ID NO: 220), NYIYKYSF (SEQ ID NO: 221), PYIYTYQF (SEQ ID NO: 222), SFTYTYEW (SEQ ID NO: 223), SYIYIYQW (SEQ ID NO: 224), SYNYTYSW (SEQ ID NO: 225), SYSYSYEY (SEQ ID NO: 226), SYTYNYDF (SEQ ID NO: 227), SYTYNYEW (SEQ ID NO: 228), SYTYNYQF (SEQ ID NO: 229), SYVWTHNF (SEQ ID NO: 230), TYKYVYEW (SEQ ID NO: 231), TYTYTYEF (SEQ ID NO: 232), TYTYTYEW (SEQ ID NO: 233), VFTYTYEF (SEQ ID NO: 234), AYTYEW (SEQ ID NO: 235), DYIYTY (SEQ ID NO: 236), IHSYEF (SEQ ID NO: 237), SFTYEF (SEQ ID NO: 238), SHSYEF (SEQ ID NO: 239), THTYEF (SEQ ID NO: 240), TWTYEF (SEQ ID NO:

241), TYNYEW (SEQ ID NO: 242), TYSYEF (SEQ ID NO: 243), TYSYEH (SEQ ID NO: 244), TYTYDF (SEQ ID NO: 245), TYTYEF (SEQ ID NO: 246), TYTYEW (SEQ ID NO: 247), AYEF (SEQ ID NO: 248), AYSF (SEQ ID NO: 249), AYSY (SEQ ID NO: 250), CYSF (SEQ ID NO: 251), DYTY (SEQ ID NO: 252), KYEH (SEQ ID NO: 253), KYEW (SEQ ID NO: 254), MYEF (SEQ ID NO: 255), NWIY (SEQ ID NO: 256), NYDY (SEQ ID NO: 257), NYQW (SEQ ID NO: 258), NYSF (SEQ ID NO: 259), PYEW (SEQ ID NO: 260), RYNW (SEQ ID NO: 261), RYTY (SEQ ID NO: 262), SYEF (SEQ ID NO: 263), SYEH (SEQ ID NO: 264), SYEW (SEQ ID NO: 265), SYKW (SEQ ID NO: 266), SYTY (SEQ ID NO: 267), TYDF (SEQ ID NO: 268), TYEF (SEQ ID NO: 269), TYEW (SEQ ID NO: 270), TYQW (SEQ ID NO: 271), TYTY (SEQ ID NO: 272), or VYEW (SEQ ID NO: 273).

In some embodiments of each or any of the above or below mentioned embodiments, the $(X^aX^b)_z$ motif is YXYXYX.

In some embodiments of each or any of the above or below mentioned embodiments, the ultralong CDR3 comprises a $X^1X^2X^3X^4X^5X_n$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q), and wherein n is 27-54.

In some embodiments of each or any of the above or below mentioned embodiments, the ultralong CDR3 comprises $X_n(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4.

In some embodiments of each or any of the above or below mentioned embodiments, the ultralong CDR3 comprises a $X^1X^2X^3X^4X^5X_n(X^aX^b)_z$ motif, wherein $X_1$ is threonine (T), glycine (G), alanine (A), serine (S), or valine (V), wherein $X_2$ is serine (S), threonine (T), proline (P), isoleucine (I), alanine (A), valine (V), or asparagine (N), wherein $X_3$ is valine (V), alanine (A), threonine (T), or aspartic acid (D), wherein $X_4$ is histidine (H), threonine (T), arginine (R), tyrosine (Y), phenylalanine (F), or leucine (L), wherein $X_5$ is glutamine (Q), $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4.

In some embodiments of each or any of the above or below mentioned embodiments, the $X^1X^2X^3X^4X^5$ motif is TTVHQ (SEQ ID NO: 153) or TSVHQ (SEQ ID NO: 154), and wherein the $(X^aX^b)_z$ motif is YXYXYX.

In some embodiments of each or any of the above or below mentioned embodiments, the ultralong CDR3 comprises: a $CX^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q), a cysteine motif selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_5C$ (SEQ ID NO: 46), $CX_{10}CX_6CX_6CXCX_7C$ (SEQ ID NO: 47), $CX_{10}CX_4CX_7CXCX_5C$ (SEQ ID NO: 48), $CX_{10}CX_4CX_7CXCX_7C$ (SEQ ID NO: 49), $CX_{13}CX_8CX_8C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CXCXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_8CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CXCX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CX_5CX_7CXCX_6C$ (SEQ ID NO: 76), $CX_{10}CX_4CX_5CX_{12}CX_2C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_8CX_6C$ (SEQ ID NO: 82), $CX_{12}CX_4CX_5CX_8CX_2C$ (SEQ ID NO: 83), $CX_{12}CX_5CX_5CXCX_8C$ (SEQ ID NO: 84), $CX_{10}CX_6CX_5CXCX_4CXCX_9C$ (SEQ ID NO: 85), $CX_{11}CX_4CX_5CX_8CX_2C$ (SEQ ID NO: 86), $CX_{10}CX_6CX_5CX_8CX_2C$ (SEQ ID NO: 87), $CX_{10}CX_6CX_5CXCX_8C$ (SEQ ID NO: 88), $CX_{10}CX_6CX_5CXCX_3CX_8CX_2C$ (SEQ ID NO: 89), $CX_{10}CX_6CX_5CX_3CX_8C$ (SEQ ID NO: 90), $CX_{10}CX_6CX_5CXCX_2CX_6CX_5C$ (SEQ ID NO: 91), $CX_7CX_6CX_3CX_3CX_9C$ (SEQ ID NO: 92), $CX_5CX_5CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95); and a $(X^aX^b)_z$ motif, $X^a$ is any amino acid residue, $X^b$ is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the ultralong CDR3 comprises: a $CX^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q); a cysteine motif selected from the group consisting of: wherein the cysteine motif is selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_9CX_3CXCX_2CXCCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_8CX_5CX_4CX_3CX_4CCXCX_1C$ (SEQ ID NO: 103), $CCX_6CCX_5CCCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCXCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_3CX_3C$ (SEQ ID NO: 112), $CX_8CCXCX_3CCX_3CXCX_3CX_4C$ (SEQ ID NO: 113), $CX_9CCX_4CX_2CXCCXCX_4CX_3C$ (SEQ ID NO: 114), $CX_{10}CXCX_3CX_2CXCCX_4CX_5CXC$ (SEQ ID NO: 115), $CX_9CXCX_3CX_2CXCCX_4CX_5CXC$ (SEQ ID NO: 116), $CX_6CCXCX_5CX_4CCXCX_5CX_2C$ (SEQ ID NO: 117), $CX_6CCXCX_3CXCCX_3CX_4CC$ (SEQ ID NO: 118), $CX_6CCXCX_3CXCX_2CXCX_4CX_8C$ (SEQ ID NO: 119), $CX_4CX_2CCX_3CXCX_4CCX_2CX_3C$ (SEQ ID NO: 120), $CX_3CX_5CX_3CCCX_4CX_9C$ (SEQ ID NO: 121), $CCX_9CX_3CXCCX_3CX_5C$ (SEQ ID NO: 122), $CX_9CX_2CX_3CX_4CCX_4CX_5C$ (SEQ ID NO: 123), $CX_9CX_7CX_4CCXCX_7CX_3C$ (SEQ ID NO: 124), $CX_9CX_3CCCX_{10}CX_2CX_3C$ (SEQ ID NO: 125), $CX_3CX_5CX_5CX_4CCX_{10}CX_6C$ (SEQ ID NO: 126), $CX_9CX_5CX_4CCXCX_5CX_4C$ (SEQ ID NO: 127), $CX_7CXCX_6CX_4CCCX_{10}C$ (SEQ ID NO: 128), $CX_8CX_2CX_4CCX_4CX_3CX_3C$ (SEQ ID NO: 129), $CX_7CX_5CXCX_4CCX_7CX_4C$ (SEQ ID NO: 130), $CX_{11}CX_3CX_4CCCX_8CX_2C$ (SEQ ID NO: 131), $CX_2CX_3CX_4CCX_4CX_5CX_{15}C$ (SEQ ID NO: 132), $CX_9CX_5CX_4CCX_7C$ (SEQ ID NO: 133), $CX_9CX_7CX_3CX_2CX_6C$ (SEQ ID NO: 134), $CX_9CX_5CX_4CCX_{14}C$ (SEQ ID NO: 135), $CX_9CX_5CX_4CCX_8C$ (SEQ ID NO: 136), $CX_9CX_6CX_4CCXC$ (SEQ ID NO: 137), $CX_5CCX_7CX_4CX_{12}$ (SEQ ID NO: 138), $CX_{10}CX_3CX_4CCX_4C$ (SEQ ID NO: 139), $CX_9CX_4CCX_5CX_4C$ (SEQ ID NO: 140), $CX_{10}CX_3CX_4CX_7CXC$ (SEQ ID NO: 141), $CX_7CX_7CX_2CX_2CX_3C$ (SEQ ID NO: 142), $CX_9CX_4CX_4CCX_6C$ (SEQ ID NO: 143), $CX_7CXCX_3CXCX_6C$ (SEQ ID NO: 144), $CX_7CXCX_4CXCX_4C$ (SEQ ID NO: 145), $CX_9CX_5CX_4C$ (SEQ ID NO: 146), $CX_3CX_6CX_8C$ (SEQ ID NO: 147), $CX_{10}CXCX_4C$ (SEQ ID NO: 148), $CX_{10}CCX_4C$ (SEQ ID NO: 149), $CX_{15}C$ (SEQ ID NO: 150), $CX_{10}C$ (SEQ ID NO: 151), and $CX_9C$ (SEQ ID NO: 152); and ba $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the ultralong CDR3 comprises an additional sequence that is a linker.

In some embodiments of each or any of the above or below mentioned embodiments, the linker is linked to a C-terminus, a N-terminus, or both C-terminus and N-terminus of the non-antibody sequence.

In some embodiments of each or any of the above or below mentioned embodiments, the ultralong CDR3 is a ruminant CDR3.

In some embodiments of each or any of the above or below mentioned embodiments, the ruminant is a cow.

In some embodiments of each or any of the above or below mentioned embodiments, the humanized antibody or binding fragment thereof comprises a human heavy chain variable region framework sequence.

In some embodiments of each or any of the above or below mentioned embodiments, the humanized antibody or binding fragment thereof comprises a human heavy chain germline sequence or is a derived from a human heavy chain germline sequence.

In some embodiments of each or any of the above or below mentioned embodiments, the heavy chain variable region comprises an amino acid sequence of SEQ ID NO: 735.

In some embodiments of each or any of the above or below mentioned embodiments, the heavy chain variable region comprises an amino acid sequence of SEQ ID NO: 737.

In some embodiments of each or any of the above or below mentioned embodiments, the heavy chain variable region comprises an amino acid sequence of SEQ ID NO: 739.

In some embodiments of each or any of the above or below mentioned embodiments, the heavy chain variable region comprises an amino acid sequence of SEQ ID NO: 741.

In some embodiments of each or any of the above or below mentioned embodiments, the heavy chain variable region comprises an amino acid sequence of SEQ ID NO: 743.

In some embodiments of each or any of the above or below mentioned embodiments, the heavy chain variable region comprises an amino acid sequence of SEQ ID NO: 745.

In some embodiments of each or any of the above or below mentioned embodiments, the heavy chain variable region comprises an amino acid sequence of SEQ ID NO: 747.

In some embodiments of each or any of the above or below mentioned embodiments, the heavy chain variable region comprises an amino acid sequence of SEQ ID NO: 749.

In some embodiments of each or any of the above or below mentioned embodiments, the ultralong CDR3 comprises an amino acid sequence of: (i) any one of GSKHRLRDYFLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507); (ii) any one of EAGGPDYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515); (iii) any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523); (iv) any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529); (v) any one of DKGDSDYDYNL (SEQ ID NO: 530), DKGDSDYDYN (SEQ ID NO: 531), DKGDSDYDY (SEQ ID NO: 532), DKGDSDYD (SEQ ID NO: 533), DKGDSDY (SEQ ID NO: 534), DKGDSD (SEQ ID NO: 535); or (vi) TSVHQETKKYQS (SEQ ID NO: 498).

In some embodiments of each or any of the above or below mentioned embodiments, the ultralong CDR3 comprises an amino acid sequence of: (i) any one of YGPNYEEWGDYLATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541); (ii) any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548); (iii) any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNYHYMDV (SEQ ID NO: 553), or GYYNYHYMDV (SEQ ID NO: 554); (iv) any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563); (v) any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569); or (vi) SYTYNYEWHVDV (SEQ ID NO: 499).

In some embodiments of each or any of the above or below mentioned embodiments, the humanized antibody or binding fragment thereof comprises a light chain variable region sequence.

In some embodiments of each or any of the above or below mentioned embodiments, the humanized antibody or binding fragment thereof comprises a light chain variable region comprising a sequence selected from the group of: (i) SEQ ID NO: 750, (ii) SEQ ID NO: 751, (iii) SEQ ID NO: 752, and (iv) SEQ ID NO: 753.

In some embodiments of each or any of the above or below mentioned embodiments, the light chain variable region sequence is a lambda light chain variable region sequence.

In some embodiments of each or any of the above or below mentioned embodiments, the light chain variable region sequence is a human lambda light chain variable region sequence.

In some embodiments of each or any of the above or below mentioned embodiments, the light chain variable region sequence comprises a VL1-51 germline sequence.

In some embodiments of each or any of the above or below mentioned embodiments, the light chain variable region is derived from a VL1-51 germline sequence.

In some embodiments of each or any of the above or below mentioned embodiments, the VL1-51 germline sequence comprises a CDR1 comprising Ile29Val and Asn32Gly substitution based on Kabat numbering.

In some embodiments of each or any of the above or below mentioned embodiments, the VL1-51 germline sequence comprises a CDR2 comprising a substitution of DNN to GDT.

In some embodiments of each or any of the above or below mentioned embodiments, the VL1-51 germline sequence comprises a CDR2 comprising a substitution of DNNKRP (SEQ ID NO: 471) to GDTSRA (SEQ ID NO: 472).

In some embodiments of each or any of the above or below mentioned embodiments, the VL1-51 germline sequence comprises a S2A, T5N, P8S, A12G, A13S, and P14L substitution based on Kabat numbering.

In some embodiments of each or any of the above or below mentioned embodiments, the VL1-51 germline sequence comprises a S2A, T5N, P8S, A12G, A13S, and P14L substitution based on Kabat numbering, and a CDR2 comprising a substitution of DNN to GDT.

In some embodiments of each or any of the above or below mentioned embodiments, the humanized antibody or binding fragment thereof comprising (a) a heavy chain variable region comprising a sequence selected from the group consisting of SEQ ID NO: 740, SEQ ID NO: 741, SEQ ID NO:742, and SEQ ID NO: 743; and (b) a light chain variable region comprising SEQ ID NO: 750.

In some embodiments of each or any of the above or below mentioned embodiments, the humanized antibodies or binding fragments thereof are present in a spatially addressed format.

The present disclosure also provides a method of humanizing an antibody variable region comprising the step of genetically combining a nucleic acid sequence encoding an ultralong CDR3 with a nucleic acid sequence encoding a variable region sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO: 747, and (viii) SEQ ID NO: 748 or SEQ ID NO: 749.

The present disclosure also provides a method of generating a library of humanized antibodies that comprises an ultralong CDR3, the method comprising: combining a nucleic acid sequence encoding an ultralong CDR3 with a nucleic acid sequence encoding a variable region sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO: 747, and (viii) SEQ ID NO: 748 or SEQ ID NO: 749, to produce nucleic acids encoding for humanized antibodies that comprises an ultralong CDR3; and expressing the nucleic acids encoding for humanized antibodies that comprises an ultralong CDR3 to generate a library of humanized antibodies that comprises an ultralong CDR3.

The present disclosure also provides a method of generating a library of humanized antibodies or binding fragments thereof comprising an ultralong CDR3 and which comprises a non-antibody sequence, the method comprising: combining a nucleic acid sequence encoding an ultralong CDR3, a nucleic acid sequence encoding a variable region sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO: 747, and (viii) SEQ ID NO: 748 or SEQ ID NO: 749, and a nucleic acid sequence encoding a non-antibody sequence to produce nucleic acids encoding humanized antibodies or binding fragments thereof comprising an ultralong CDR3 and a non-antibody sequence, and expressing the nucleic acids encoding humanized antibodies or binding fragments thereof comprising an ultralong CDR3 and a non-antibody sequence to generate a library of humanized antibodies or binding fragments thereof comprising an ultralong CDR3 and a non-antibody sequence. In some embodiments, the ultralong CDR3 comprises a bovine, a non-bovine, an antibody, or a non-antibody sequence.

The present disclosure also provides a library of humanized antibodies or binding fragments thereof comprising an ultralong CDR3 which comprises a non-bovine or a non-antibody sequence. For example, the non-antibody sequence (e.g., a non-antibody human sequence) is inserted into the CDR3, including optionally, wherein a portion of CDR3 (e.g., one or more amino acids of the CDR3) or the entire CDR3 sequence (e.g., all or substantially all of the amino acids of the CDR3) is removed.

The present disclosure also provides a method of generating a library of humanized antibodies or binding fragments thereof comprising an ultralong CDR3 which comprises a cysteine motif, the method comprising: combining a human variable region framework (FR) sequence, and a nucleic acid sequence encoding an ultralong CDR3 and a cysteine motif; introducing one or more nucleotide changes to the nucleic acid sequence encoding one or more amino acid residues that are positioned between one or more cysteine residues in the cysteine motif for nucleotides encoding different amino acid residues to produce nucleic acids encoding humanized antibodies or binding fragments thereof comprising an ultralong CDR3 and a cysteine motif with one or more nucleotide changes introduced between one or more cysteine residues in the cysteine domain; and expressing the nucleic acids encoding humanized antibodies or binding fragments thereof comprising an ultralong CDR3 and a cysteine motif with one or more nucleotide changes introduced between one or more cysteine residues in the cysteine domain to generate a library of humanized antibodies or binding fragments thereof comprising an ultralong CDR3 and a cysteine motif with one or more amino acid changes introduced between one or more cysteine residues in the cysteine domain.

The present disclosure also provides a library of humanized antibodies or binding fragments thereof comprising an ultralong CDR3 which comprises a cysteine motif, wherein the antibodies or binding fragments comprise one or more substitutions of amino acid residues that are positioned between cysteine residues in the cysteine motif.

The present disclosure also provides a method of generating a library of humanized antibodies or binding fragments thereof comprising a bovine ultralong CDR3, the method comprising: combining a nucleic acid sequence encoding a human variable region framework (FR) sequence and a nucleic acid encoding a bovine ultralong CDR3, and expressing the nucleic acids encoding a human variable region framework (FR) sequence and a nucleic acid encoding a bovine ultralong CDR3 to generate a library of humanized antibodies or binding fragments thereof comprising a bovine ultralong CDR3.

The present disclosure also provides a library of humanized antibodies or binding fragments thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO: 747, and (viii) SEQ ID NO: 748 or SEQ ID NO: 749; and (b) a bovine ultralong CDR3.

The present disclosure also provides an antibody heavy chain variable region comprising a sequence of the formula V1-X-V2, wherein V1 comprises an amino acid sequence selected from the group consisting of: (i) QVQLREWGAGLLKPSETLSLTCAVYGGSFSGYYWSWIRQPPGKGLEWIGEINHSGSTN YNPSLKSRVTISVDTSKNQFSLKLSSVTAADTAVYYC (SEQ ID NO: 735), (ii) QVQLREWGAGLLKPSETLSLTCAVYGGSFSDKYWSWIRQPPGKGLEWIGEINHSGSTN YNPSLKSRVTISVDTSKNQFSLKLSSVTAADTAVYYC (SEQ ID NO: 737), (iii) QVQLREWGAGLLKPSETLSLTCAVYGGSFSGYYWSWIRQPPGKGLEWIGSINHSGSTN YNPSLKSRVTISVDTSKNQFSLKLSSVTAADTAVYYC (SEQ ID NO: 739), (iv) QVQLREWGAGLLKPSETLSLTCAVYGGSFSDKYWSWIRQPPGKGLEWIGSINHSGSTN YNPSLKSRVTISVDTSKNQFSLKLSSVTAADTAVYYC (SEQ ID NO: 741), (v) QVQLREWGAGLLKPSETLSLTCASGFSLSDKAVGWIRQPPGKGLEWIGEINHSGSTNY NPSLKSRVTISVDTSKNQFSLKLSSVTAADTAVYYC (SEQ ID NO: 743), (vi) QVQLREWGAGLLKPSETLSLTCAVYGGLGSIDTGGNTGSFSGYYWSWIRQPPGKGLEW YNPSLKSRVTISVDTSKNQFSLKLSSVTAADTAVYYC (SEQ ID NO: 745), (vii) QVQLREWGAGLLKPSETLSLTCASGFSLSDKAVGWIRQPPGKGLEWIGSINHSGSTNY NPSLKSRVTISVDTSKNQFSLKLSSVTAADTAVYYC (SEQ ID NO: 747), and (viii) QVQLREWGAGLLKPSETLSLTCASGFSLSDKAVGWIRQPPGKGLEWLGSIDTGGNTG YNPSLKSRVTISVDTSKNQFSLKLSSVTAADTAVYYC (SEQ ID NO: 749); wherein X comprises an ultralong CDR3, wherein X comprises an ultralong CDR3, which can include a non-human sequence or a non-antibody sequence (e.g., a non-antibody human sequence) that has been inserted into the CDR3 sequence of the antibody, including optionally, removing a portion of CDR3 (e.g., one or more amino acids of the CDR3) or the entire CDR3 sequence (e.g., all or substantially all of the amino acids of the CDR3); and wherein V2 comprises an amino acid sequence selected from the group consisting of: (i) WGHGTAVTVSS (SEQ ID NO: 570), (ii) WGKGTTVTVSS (SEQ ID NO: 571), (iii) WGKGTTVTVSS (SEQ ID NO: 572), (iv) WGRGTLVTVSS (SEQ ID NO: 573), (v) WGKGTTVTVSS (SEQ ID NO: 574), and (vi) WGQGLLVTVSS (SEQ ID NO: 500).

In some embodiments of each or any of the above or below mentioned embodiments, the ultralong CDR3 comprises an amino acid sequence of: (i) any one of GSKHRLRDYFLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507); (ii) any one of EAGGPDYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515); (iii) any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523); (iv) any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529); (v) any one of DKGDSDYDYNL (SEQ ID NO: 530), DKGDSDYDYN (SEQ ID NO: 531), DKGDSDYDY (SEQ ID NO: 532), DKGDSDYD (SEQ ID NO: 533), DKGDSDY (SEQ ID NO: 534), DKGDSD (SEQ ID NO: 535); or (vi) TSVHQETKKYQS (SEQ ID NO: 498).

In some embodiments of each or any of the above or below mentioned embodiments, the ultralong CDR3 comprises an amino acid sequence of: (i) any one of YGPNYEEWGDYLATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541); (ii) any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548); (iii) any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNYHYMDV (SEQ ID NO: 553), or GYYNYHYMDV (SEQ ID NO: 554); (iv) any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563); (v) any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569); or (vi) SYTYNYEWHVDV (SEQ ID NO: 499).

In some embodiments of each or any of the above or below mentioned embodiments, the ultralong CDR3 comprises an amino acid sequence of: (i) any one of GSKHRLRDYFLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507), and any one of YGPNYEEWGDYLATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541); (ii) any one of EAGGPDYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515), and any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548); (iii) any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523), and any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNYHYMDV (SEQ ID NO: 553), or GYYNYHYMDV (SEQ ID NO: 554); (iv) any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529), and any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563); (v) any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), and any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569); or (vi) TSVHQETKKYQS (SEQ ID NO: 498) and SYTYNYEWHVDV (SEQ ID NO: 499).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of GSKHRLRDYFLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507), and an amino acid sequence of any one of YGPNYEEWGDYLATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541), and wherein V2 comprises an amino acid sequence selected of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of EAGGPDYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515), and an amino acid sequence of any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548), and wherein V2 comprises an amino acid sequence selected of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of EAGGPIWH-DDVKY (SEQ ID NO: 516), EAGGPIWHDDVK (SEQ ID NO: 517), EAGGPIWHDDV (SEQ ID NO: 518), EAGG-PIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523), and an amino acid sequence of any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNY-HYMDV (SEQ ID NO: 553), or GYYNYHYMDV (SEQ ID NO: 554), and wherein V2 comprises an amino acid sequence selected of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of GTDYTID-DQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529), and an amino acid sequence of any one of QGIRYQGSGTFWYFDV (SEQ ID NO: 555), GIRY-QGSGTFWYFDV (SEQ ID NO: 556), IRYQGSGTF-WYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563), and wherein V2 comprises an amino acid sequence selected of WGQGLLVTVSS (SEQ ID NO: 500).

In some embodiments of each or any of the above or below mentioned embodiments, the antibody heavy chain variable region includes wherein V 1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of YNLGYSY-FYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), and any one of YNLGYSYFYYMDG (SEQ ID NO: 564), NLGYSYFYYMDG (SEQ ID NO: 565), LGYSY-FYYMDG (SEQ ID NO: 566), GYSYFYYMDG (SEQ ID NO: 567), YSYFYYMDG (SEQ ID NO: 568), or SYFYYMDG (SEQ ID NO: 569), and wherein V2 comprises an amino acid sequence selected of WGQGLLVTVSS (SEQ ID NO: 500).

In some embodiments of each or any of the above or below mentioned embodiments, the antibody heavy chain variable region includes wherein the ultralong CDR3 is 35 amino acids in length or longer, 40 amino acids in length or longer, 45 amino acids in length or longer, 50 amino acids in length or longer, 55 amino acids in length or longer, or 60 amino acids in length or longer.

In some embodiments of each or any of the above or below mentioned embodiments, the antibody heavy chain variable region includes wherein the ultralong CDR3 is 35 amino acids in length or longer.

In some embodiments of each or any of the above or below mentioned embodiments, the antibody heavy chain variable region includes wherein the ultralong CDR3 comprises a cysteine motif.

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of GSKHRLRDY-FLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507), a cysteine motif, and an amino acid sequence of any one of YGPNYEEWGDY-LATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEE-WGDYLATLDV (SEQ ID NO: 540), or EEWGDY-LATLDV (SEQ ID NO: 541), and wherein V2 comprises an amino acid sequence of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of EAGGP-DYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515), a cysteine motif, and an amino acid sequence of any one of YDFYDGYYNYHYMDV (SEQ ID NO: 542), DFY-DGYYNYHYMDV (SEQ ID NO: 543), FYDGYYNY-HYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548), and wherein V2 comprises an amino acid sequence selected of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of EAGGPIWH-DDVKY (SEQ ID NO: 516), EAGGPIWHDDVK (SEQ ID NO: 517), EAGGPIWHDDV (SEQ ID NO: 518), EAGG-PIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523), a cysteine motif, and an amino acid sequence of any one of YDFNDGYYNY-HYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNY-HYMDV (SEQ ID NO: 553), or GYYNYHYMDV (SEQ ID NO: 554), and wherein V2 comprises an amino acid sequence selected of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529), a cysteine motif, and an amino acid sequence of any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563), and wherein V2 comprises an amino acid sequence selected of WGQGLLVTVSS (SEQ ID NO: 500).

In some embodiments of each or any of the above or below mentioned embodiments, the antibody heavy chain variable region includes wherein V comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), a cysteine motif, and an amino acid sequence of any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), and wherein V2 comprises an amino acid sequence selected of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence that is SEQ ID NO: 498 and an amino acid sequence that is SEQ ID NO: 499, and wherein V2 comprises an amino acid sequence that is SEQ ID NO: 500.

In some embodiments of each or any of the above or below mentioned embodiments, the antibody heavy chain variable region includes wherein the cysteine motif is selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_8C$ (SEQ ID NO: 46), $CX_{10}CX_6CX_6CXCX_7C$ (SEQ ID NO: 47), $CX_{10}CX_4CX_7CXCX_8C$ (SEQ ID NO: 48), $CX_{10}CX_4CX_7CXCX_7C$ (SEQ ID NO: 49), $CX_{13}CX_8CX_8C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CX_5CXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_8CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CX_5CX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CX_5CX_7CXCX_6C$ (SEQ ID NO: 76), $CX_{10}CX_4CX_5CX_{12}CX_2C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_8CX_6C$ (SEQ ID NO: 82), $CX_{12}CX_4CX_5CX_8CX_2C$ (SEQ ID NO: 83), $CX_{12}CX_5CX_5CXCX_8C$ (SEQ ID NO: 84), $CX_{10}CX_6CX_5CXCX_4CXCX_9C$ (SEQ ID NO: 85), $CX_{11}CX_4CX_5CX_8CX_2C$ (SEQ ID NO: 86), $CX_{10}CX_6CX_5CX_8CX_2C$ (SEQ ID NO: 87), $CX_{10}CX_6CX_5CXCX_8C$ (SEQ ID NO: 88), $CX_{10}CX_6CX_5CXCX_3CX_8CX_2C$ (SEQ ID NO: 89), $CX_{10}CX_6CX_5CX_3CX_8C$ (SEQ ID NO: 90), $CX_{10}CX_6CX_5CXCX_2CX_6CXC$ (SEQ ID NO: 91), $CX_7CX_6CX_3CX_3CX_9C$ (SEQ ID NO: 92), $CX_9CX_8CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95).

In some embodiments of each or any of the above or below mentioned embodiments, the antibody heavy chain variable region includes wherein the cysteine motif is selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_9CX_3CXCX_2CXCCCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_8CX_5CX_4CX_3CX_4CCXCX_1C$ (SEQ ID NO: 103), $CCX_6CCX_5CCCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCXCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_3CX_3C$ (SEQ ID NO: 112), $CX_8CCXCX_3CCX_3CXCX_3CX_4C$ (SEQ ID NO: 113), $CX_9CCX_4CX_2CXCCCX_4CX_3C$ (SEQ ID NO: 114), $CX_{10}CXCX_3CX_2CXCX_4CX_5CXC$ (SEQ ID NO: 115), $CX_3CXCX_3CX_2CXCCX_4CX_5CXC$ (SEQ ID NO: 116), $CX_6CCXCX_5CX_4CCXCX_5CX_2C$ (SEQ ID NO: 117), $CX_6CCXCX_3CXCCX_3CX_4CC$ (SEQ ID NO: 118), CX$_6$CCXCX$_3$CXCX$_2$CXCX$_4$CXC (SEQ ID NO: 119), CX$_4$CX$_2$CCX$_3$CXCX$_4$CCX$_2$CX$_3$C (SEQ ID NO: 120), CX$_3$CX$_5$CX$_3$CCCX$_4$CX$_9$C (SEQ ID NO: 121), CCX$_9$CX$_3$CXCCX$_3$CX$_5$C (SEQ ID NO: 122), CX$_9$CX$_2$CX$_3$CX$_4$CCX$_4$CX$_5$C (SEQ ID NO: 123), CX$_9$CX$_7$CX$_4$CCXCX$_7$CX$_3$C (SEQ ID NO: 124), CX$_9$CX$_3$CCCX$_{10}$CX$_2$CX$_3$C (SEQ ID NO: 125), CX$_3$CX$_5$CX$_5$CX$_4$CCX$_{10}$CX$_6$C (SEQ ID NO: 126), CX$_9$CX$_5$CX$_4$CCXCX$_5$CX$_4$C (SEQ ID NO: 127), CX$_7$CXCX$_6$CX$_4$CCCX$_{10}$C (SEQ ID NO: 128), CX$_8$CX$_2$CX$_4$CCX$_4$CX$_3$CX$_3$C (SEQ ID NO: 129), CX$_7$CX$_5$CXCX$_4$CCX$_7$CX$_4$C (SEQ ID NO: 130), CX$_{11}$CX$_3$CX$_4$CCCX$_8$CX$_2$C (SEQ ID NO: 131), CX$_2$CX$_3$CX$_4$CCX$_4$CX$_5$CX$_{15}$C (SEQ ID NO: 132), CX$_9$CX$_5$CX$_4$CCX$_7$C (SEQ ID NO: 133), CX$_9$CX$_7$CX$_3$CX$_2$CX$_6$C (SEQ ID NO: 134), CX$_9$CX$_5$CX$_4$CCX$_{14}$C (SEQ ID NO: 135), CX$_9$CX$_5$CX$_4$CCX$_8$C (SEQ ID NO: 136), CX$_9$CX$_6$CX$_4$CCXC (SEQ ID NO: 137), CX$_5$CCX$_7$CX$_4$CX$_{12}$ (SEQ ID NO: 138), CX$_{10}$CX$_3$CX$_4$CCX$_4$C (SEQ ID NO: 139), CX$_9$CX$_4$CCX$_5$CX$_4$C (SEQ ID NO: 140), CX$_{10}$CX$_3$CX$_4$CX$_7$CXC (SEQ ID NO: 141), CX$_7$CX$_7$CX$_2$CX$_2$CX$_3$C (SEQ ID NO: 142), CX$_9$CX$_4$CX$_4$CCX$_6$C (SEQ ID NO: 143), CX$_7$CXCX$_3$CXCX$_6$C (SEQ ID NO: 144), CX$_7$CXCX$_4$CXCX$_4$C (SEQ ID NO: 145), CX$_9$CX$_5$CX$_4$C (SEQ ID NO: 146), CX$_3$CX$_6$CX$_8$C (SEQ ID NO: 147), CX$_{10}$CXCX$_4$C (SEQ ID NO: 148), CX$_{10}$CCX$_4$C (SEQ ID NO: 149), CX$_{15}$C (SEQ ID NO: 150), CX$_{10}$C (SEQ ID NO: 151), and CX$_9$C (SEQ ID NO: 152).

In some embodiments of each or any of the above or below mentioned embodiments, the antibody heavy chain variable region includes wherein the ultralong CDR3 comprises 2 to 6 disulfide bonds.

In some embodiments of each or any of the above or below mentioned embodiments, the antibody heavy chain variable region includes wherein the ultralong CDR3 comprises a non-antibody sequence.

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of GSKHRLRDYFLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507), a non-antibody sequence, and an amino acid sequence of any one of YGPNYEEWGDYLATLDV (SEQ ID NO: 536), GPNYEEWGDYLATLDV (SEQ ID NO: 537), PNYEEWGDYLATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541), and wherein V2 comprises an amino acid sequence of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of EAGGPDYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515), a non-antibody sequence, and an amino acid sequence of any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548), and wherein V2 comprises an amino acid sequence selected of WGQGLLVTVSS (SEQ ID NO: 500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523), a non-antibody sequence, and an amino acid sequence of any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNYHYMDV (SEQ ID NO: 553), or GYYNYHYMDV (SEQ ID NO: 554), and wherein V2 comprises an amino acid sequence selected of WGQGLLVTVSS (SEQ ID NO: 500).

In some embodiments of each or any of the above or below mentioned embodiments, the antibody heavy chain variable region includes wherein V comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529), a non-antibody sequence, and an amino acid sequence of any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563), and wherein V2 comprises an amino acid sequence selected of WGQGLLVTVSS (SEQ ID NO:500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence of any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), a non-antibody sequence, and an amino acid sequence of any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), and wherein V2 comprises an amino acid sequence selected of WGQGLLVTVSS (SEQ ID NO:500).

In some embodiments of each or any of the above or below mentioned embodiments, the antibody heavy chain variable region includes wherein V1 comprises an amino acid sequence selected from the group consisting of SEQ ID NO:735, SEQ ID NO: 737, SEQ ID NO: 739, SEQ ID NO: 741, SEQ ID NO: 743, SEQ ID NO: 745, SEQ ID NO: 747, and SEQ ID NO: 749, wherein the ultralong CDR3 comprises an amino acid sequence that is SEQ ID NO: 498 and an amino acid sequence that is SEQ ID NO: 499, and wherein V2 comprises an amino acid sequence that is SEQ ID NO: 500.

In some embodiments of each or any of the above or below mentioned embodiments, the antibody heavy chain variable region includes wherein the non-antibody sequence is a synthetic sequence.

In some embodiments of each or any of the above or below mentioned embodiments, the antibody heavy chain variable region includes wherein the non-antibody sequence is a cytokine sequence, a lymphokine sequence, a chemokine sequence, a growth factor sequence, a hormone sequence, or a toxin sequence.

In some embodiments of each or any of the above or below mentioned embodiments, the antibody heavy chain variable region includes wherein the non-antibody sequence is an IL-8 sequence, an IL-21 sequence, an SDF-1 (alpha) sequence, a somatostatin sequence, a chlorotoxin sequence, a Pro-TxII sequence, a ziconotide sequence, an ADWX-1 sequence, an HsTx1 sequence, an OSK1 sequence, a Pi2 sequence, a Hongotoxin (HgTX) sequence, a Margatoxin sequence, an Agitoxin-2 sequence, a Pi3 sequence, a Kaliotoxin sequence, an Anuroctoxin sequence, a Charybdotoxin sequence, a Tityustoxin-K-alpha sequence, a Maurotoxin sequence, a Ceratotoxin 1 (CcoTx1) sequence, a CcoTx2 sequence, a CcoTx3 sequence, a Phrixotoxin 3 (PaurTx3) sequence, a Hanatoxin 1 sequence, a Phrixotoxin 1 sequence, a Huwentoxin-IV sequence, an α-conotoxin ImI sequence, an α-conotoxin EpI sequence, an α-conotoxin PnIA sequence, an α-conotoxin PnIB sequence, an α-conotoxin MII sequence, an α-conotoxin AuIA sequence, an α-conotoxin AuIB sequence, an α-conotoxin AuIC sequence, a conotoxin κ-PVIIA sequence, a charybdotoxin sequence, a neurotoxin B-IV sequence, a crotamine sequence, a ω-GVIA (conotoxin) sequence, a κ-hefutoxin 1 sequence, a Css4 sequence, a Bj-xtrIT sequence, a BcIV sequence, a Hm-1 sequence, a Hm-2 sequence, a GsAF-I (β-theraphotoxin-Gr1b) sequence, a Protoxin I (ProTx-I sequence, a β-theraphotoxin-Tp1a) sequence, a Protoxin II (ProTx II) sequence, a Huwentoxin I sequence, a μ-Conotoxin PIIIA sequence, a Jingzhaotoxin-III (β-TRTX-Cj1α) sequence, a GsAF-II (Kappa-theraphotoxin-Gr2c) sequence, a ShK (Stichodactyla toxin) sequence, a HsTx1 sequence, a Guangxitoxin 1E (GxTx-1E) sequence, a Maurotoxin sequence, a Charybdotoxin (ChTX) sequence, an Iberiotoxin (IbTX) sequence, a Leiurotoxin 1 (scyllatoxin) sequence, a Tamapin sequence, a Kaliotoxin-1 (KTX) sequence, a Purotoxin1 (PT-1) sequence, or a GpTx-1 sequence, a MOKA Toxin sequence, a OSK1 (P12, K16, D20) sequence, a OSK1 (K16, D20) sequence, a HmK sequence, a ShK (K16,Y26, K29) sequence, a ShK (K16) sequence, a ShK-A (K16) sequence, a ShK (K16,E30) sequence, a ShK (Q21) sequence, a ShK (L21) sequence, a ShK (F21) sequence, a ShK (I21) sequence, or a ShK (A21) sequence.

In some embodiments of each or any of the above or below mentioned embodiments, the antibody heavy chain variable region includes wherein the non-antibody sequence is any one of SEQ ID NOS: 475-481, 599-655, 666-698, 727-733, 808-810, and 831-835.

In some embodiments of each or any of the above or below mentioned embodiments, the antibody heavy chain variable region includes wherein the antibody heavy chain variable region comprises an amino acid sequence selected from the group consisting of SEQ ID NO: 770-779, 784-791, 903-922 and 925-955. Accordingly, in some aspects, the antibody heavy chain variable region comprises the amino acid sequence of SEQ ID NO: 941.

In some embodiments of each or any of the above or below mentioned embodiments, the antibody heavy chain variable region includes wherein the ultralong CDR3 comprises a linker sequence.

In some embodiments of each or any of the above or below mentioned embodiments, the antibody heavy chain variable region includes wherein the linker is linked to a N-terminus, a C-terminus, or both N-terminus and C-terminus of the non-antibody sequence.

In some embodiments of each or any of the above or below mentioned embodiments, the antibody heavy chain variable region includes wherein the linker comprises one or more amino acid sequence selected from the group consisting of SEQ ID NO: 575 to 598, 699 to 726 and 813 to 830, or any combination thereof.

In some embodiments of each or any of the above or below mentioned embodiments, the antibody heavy chain variable region includes wherein the linkers linked to both N-terminus and C-terminus have the same or different amino acid sequence.

The present disclosure also provides antibody or binding fragment thereof comprising the antibody heavy chain variable region disclosed herein.

In some embodiments of each or any of the above or below mentioned embodiments, the heavy chain variable region further comprises a constant heavy chain 1 (CH1) region.

In some embodiments of each or any of the above or below mentioned embodiments, the heavy chain variable region further comprises an amino acid sequence of SEQ ID NO: 390.

In some embodiments of each or any of the above or below mentioned embodiments, the antibody or binding fragment further comprises a light chain variable region.

In some embodiments of each or any of the above or below mentioned embodiments, the light chain variable region further comprising a constant light chain (CL) region.

The present disclosure also provides an isolated polynucleotide encoding the antibody heavy chain variable region described herein.

The present disclosure also provides a vector comprising the polynucleotide described herein.

The present disclosure also provides a host cell comprising the vector described herein.

The present disclosure also provides a nucleic acid library comprising a plurality of polynucleotides comprising nucleic acid sequences encoding for an antibody heavy chain variable region comprising a sequence of the formula V 1-X-V2, wherein V 1 comprises an amino acid sequence selected from the group consisting of:
(i) QVQLREWGAGLLKPSETLSLTCAVYGGSF-SGYYWSWIRQPPG KGLEWIGEINHSGSTNYNPSLK-SRVTISVDTSKNQFSLKLSSVTAADTAVYYC (SEQ ID NO: 735), (ii) QVQLREWGAGLLKPSETLSLTCA-VYGGSFSDKYWSWIRQPPGKGLEWIG EINHSGST-NYNPSLKSRVTISVDTSKNQFSLKLSSVTAAD-TAVYYC (SEQ ID NO: 737), (iii) QVQLREWGAGLLKPSETLSLTCAVYGGSFSGYY-WSWIRQPPGKGLEWIGSINHSGSTN YNPSLKSRVTIS-VDTSKNQFSLKLSSVTAADTAVYYC (SEQ ID NO: 739), (iv) QVQLREWGAGLLKPSETLSLTCAVYGGSF-SDKYWSWIRQPPGKGLEWIGSINHSGSTN YNPSLK-SRVTISVDTSKNQFSLKLSSVTAADTAVYYC (SEQ ID NO: 741), (v) QVQLREWGAGLLKPSETLSLTCTASGF-SLSDKAVGWIRQPPGKGLEWIGEINHSGSTNY NPSLKSRVTISVDTSKNQFSLKLSSVTAADTAVYYC (SEQ ID NO: 743), (vi) QVQLREWGAGLLKPSETLSLT-CAVYGGLGSIDTGGNTGSFSGYYWSWIRQPPGK-GLEW YNPSLKSRVTISVDTSKNQFSLKLSSVTAAD-TAVYYC (SEQ ID NO: 745), (vii) QVQLREWGAGLLKPSETLSLTCTASGFSLSDKAVG-WIRQPPGKGLEWIGSINHSGSTN NPSLKSRVTIS-VDTSKNQFSLKLSSVTAADTAVYYC (SEQ ID NO: 747), and (viii) QVQLREWGAGLLKPSETLSLTCTASGF-SLSDKAVGWIRQPPGKGLEWLGSIDTGGNTG YNPSLKSRVTISVDTSKNQFSLKLSSVTAADTAVYYC (SEQ ID NO: 749); wherein X comprises an ultralong CDR3, wherein X comprises an ultralong CDR3, which can include a non-human sequence or a non-antibody sequence (e.g., a non-antibody human sequence) that has been inserted into the CDR3 sequence of the antibody, including optionally, removing a portion of CDR3 (e.g., one or more amino acids of the CDR3) or the entire CDR3 sequence (e.g., all or substantially all of the amino acids of the CDR3); and wherein V2 comprises an amino acid sequence selected from the group consisting of: (i) WGHGTAVTVSS (SEQ ID NO: 570), (ii) WGKGTTVTVSS (SEQ ID NO: 571), (iii) WGKGTTVTVSS (SEQ ID NO: 572), (iv) WGRGTLVTVSS (SEQ ID NO: 573), (v) WGKGTTVTVSS (SEQ ID NO: 574), and (vi) WGQGLLVTVSS (SEQ ID NO: 500).

The present disclosure also provides a library of antibodies comprising antibody heavy chain variable regions comprising a sequence of the formula V 1-X-V2, wherein V1 comprises an amino acid sequence selected from the group consisting of: (i) QVQLREWGAGLLKPSETLSLTCA-VYGGSFSGYYWSWIRQPPGKGLEW IGEINHSGST-NYNPSLKSRVTISVDTSKNQFSLKLSSVTAAD-TAVYYC (SEQ ID NO: 735), (ii) QVQLREWGAGLLKPSETLSLTCAVYGGSFSDKY-WSWIRQPPGKGLEWIGEINHSGS TNYNPSLKSRVTIS-VDTSKNQFSLKLSSVTAADTAVYYC (SEQ ID NO: 737), (iii) QVQLREWGAGLLKPSETLSLTCAVYGGSF-SGYYWSWIRQPPGKGLEWIGSINHSGSTN YNPSLK-SRVTISVDTSKNQFSLKLSSVTAADTAVYYC (SEQ ID NO: 739), (iv) QVQLREWGAGLLKPSETLSLTCA-VYGGSFSDKYWSWIRQPPGKGLEWIGSINHSGSTN YNPSLKSRVTISVDTSKNQFSLKLSSVTAADTAVYYC (SEQ ID NO: 741), (v) QVQLREW-GAGLLKPSETLSLTCTASGFSLSDKAVGWIRQPPGK-GLEWIGEINHSGSTNY NPSLKSRVTISVDTSKNQF-SLKLSSVTAADTAVYYC (SEQ ID NO: 743), (vi) QVQLREWGAGLLKPSETLSLTCAVYGGLGSIDTG-GNTGSFSGYYWSWIRQPPGKGLEW YNPSLKSRVTIS-VDTSKNQFSLKLSSVTAADTAVYYC (SEQ ID NO: 745), (vii) QVQLREWGAGLLKPSETLSLTCTASGFSLS-DKAVGWIRQPPGKGLEWIGSINHSGSTNY NPSLK-SRVTISVDTSKNQFSLKLSSVTAADTAVYYC (SEQ ID NO: 747), and (viii) QVQLREW-GAGLLKPSETLSLTCTASGFSLSDKAVGWIRQPPGK-GLEWLGSIDTGGNTG YNPSLKSRVTISVDTSKNQF-SLKLSSVTAADTAVYYC (SEQ ID NO: 749); wherein X comprises an ultralong CDR3, wherein X comprises an ultralong CDR3, which can include a non-human sequence or a non-antibody sequence (e.g., a non-antibody human sequence) that has been inserted into the CDR3 sequence of the antibody, including optionally, removing a portion of CDR3 (e.g., one or more amino acids of the CDR3) or the entire CDR3 sequence (e.g., all or substantially all of the amino acids of the CDR3); and wherein V2 comprises an amino acid sequence selected from the group consisting of: (i) WGHGTAVTVSS (SEQ ID NO: 570), (ii) WGKGTTVTVSS (SEQ ID NO: 571), (iii) WGKGTTVTVSS (SEQ ID NO: 572), (iv) WGRGTLVTVSS (SEQ ID NO: 573), (v) WGKGTTVTVSS (SEQ ID NO: 574), and (vi) WGQGLLVTVSS (SEQ ID NO:500).

The antibody heavy chain variable region of claim 142, wherein the ultralong CDR3 comprises a $X_1X_2X_3X_4X_5$ motif, wherein $X_1$ is threonine (T), glycine (G), alanine (A), serine (S), or valine (V), wherein $X_2$ is serine (S), threonine (T), proline (P), isoleucine (I), alanine (A), valine (V), or asparagine (N), wherein $X_3$ is valine (V), alanine (A), threonine (T), or aspartic acid (D), wherein $X_4$ is histidine (H), threonine (T), arginine (R), tyrosine (Y), phenylalanine (F), or leucine (L), and wherein $X_5$ is glutamine (Q).

In some embodiments of each or any of the above or below mentioned embodiments, the antibody heavy chain variable region includes wherein the $X_1X_2X_3X_4X_5$ motif is TTVHQ (SEQ ID NO: 153), TSVHQ (SEQ ID NO: 154), SSVTQ (SEQ ID NO: 155), STVHQ (SEQ ID NO: 156), ATVRQ (SEQ ID NO: 157), TTVYQ (SEQ ID NO: 158), SPVHQ (SEQ ID NO: 159), ATVYQ (SEQ ID NO: 160), TAVYQ (SEQ ID NO: 161), TNVHQ (SEQ ID NO: 162), ATVHQ (SEQ ID NO: 163), STVYQ (SEQ ID NO: 164), TIVHQ (SEQ ID NO: 165), AIVYQ (SEQ ID NO: 166), TTVFQ (SEQ ID NO: 167), AAVFQ (SEQ ID NO: 168), GTVHQ (SEQ ID NO: 169), ASVHQ (SEQ ID NO: 170), TAVFQ (SEQ ID NO: 171), ATVFQ (SEQ ID NO: 172), AAAHQ (SEQ ID NO: 173), VVVYQ (SEQ ID NO: 174), GTVFQ (SEQ ID NO: 175), TAVHQ (SEQ ID NO: 176), ITVHQ (SEQ ID NO: 177), ITAHQ (SEQ ID NO: 178), VTVHQ (SEQ ID NO: 179); AAVHQ (SEQ ID NO: 180), GTVYQ (SEQ ID NO: 181), TTVLQ (SEQ ID NO: 182), TTTHQ (SEQ ID NO: 183), or TTDYQ (SEQ ID NO: 184).

In some embodiments of each or any of the above or below mentioned embodiments, the antibody heavy chain variable region includes wherein the ultralong CDR3 comprises a $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the antibody heavy chain variable region includes wherein the $(X^aX^b)_z$ motif is CYTYNYEF (SEQ ID NO: 217), HYTYTYDF (SEQ ID NO: 218), HYTYTYEW (SEQ ID NO: 219), KHRYTYEW (SEQ ID NO: 220), NYIYKYSF (SEQ ID NO: 221), PYIYTYQF (SEQ ID NO: 222), SFTYTYEW (SEQ ID NO: 223), SYIYIYQW (SEQ ID NO: 224), SYNYTYSW (SEQ ID NO: 225), SYSYSYEY (SEQ ID NO: 226), SYTYNYDF (SEQ ID NO: 227), SYTYNYEW (SEQ ID NO: 228), SYTYNYQF (SEQ ID NO: 229), SYVWTHNF (SEQ ID NO: 230), TYKYVYEW (SEQ ID NO: 231), TYTYTYEF (SEQ ID NO: 232), TYTYTYEW (SEQ ID NO: 233), VFTYTYEF (SEQ ID NO: 234), AYTYEW (SEQ ID NO: 235), DYIYTY (SEQ ID NO: 236), IHSYEF (SEQ ID NO: 237), SFTYEF (SEQ ID NO: 238), SHSYEF (SEQ ID NO: 239), THTYEF (SEQ ID NO: 240), TWTYEF (SEQ ID NO: 241), TYNYEW (SEQ ID NO: 242), TYSYEF (SEQ ID NO: 243), TYSYEH (SEQ ID NO: 244), TYTYDF (SEQ ID NO: 245), TYTYEF (SEQ ID NO: 246), TYTYEW (SEQ ID NO: 247), AYEF (SEQ ID NO: 248), AYSF (SEQ ID NO: 249), AYSY (SEQ ID NO: 250), CYSF (SEQ ID NO: 251), DYTY (SEQ ID NO: 252), KYEH (SEQ ID NO: 253), KYEW (SEQ ID NO: 254), MYEF (SEQ ID NO: 255), NWIY (SEQ ID NO: 256), NYDY (SEQ ID NO: 257), NYQW (SEQ ID NO: 258), NYSF (SEQ ID NO: 259), PYEW (SEQ ID NO: 260), RYNW (SEQ ID NO: 261), RYTY (SEQ ID NO: 262), SYEF (SEQ ID NO: 263), SYEH (SEQ ID NO: 264), SYEW (SEQ ID NO: 265), SYKW (SEQ ID NO: 266), SYTY (SEQ ID NO: 267), TYDF (SEQ ID NO: 268), TYEF (SEQ ID NO: 269), TYEW (SEQ ID NO: 270), TYQW (SEQ ID NO: 271), TYTY (SEQ ID NO: 272), or VYEW (SEQ ID NO: 273).

In some embodiments of each or any of the above or below mentioned embodiments, the antibody heavy chain variable region includes wherein the ultralong CDR3 comprises a $X^1X^2X^3X^4X^5X_n$ motif, wherein $X_1$ is threonine (T), glycine (G), alanine (A), serine (S), or valine (V), wherein $X_2$ is serine (S), threonine (T), proline (P), isoleucine (I), alanine (A), valine (V), or asparagine (N), wherein $X_3$ is valine (V), alanine (A), threonine (T), or aspartic acid (D), wherein $X_4$ is histidine (H), threonine (T), arginine (R), tyrosine (Y), phenylalanine (F), or leucine (L), wherein $X_5$ is glutamine (Q), and wherein n is 27-54.

In some embodiments of each or any of the above or below mentioned embodiments, the antibody heavy chain variable region includes wherein the ultralong CDR3 comprises $X_n(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4.

In some embodiments of each or any of the above or below mentioned embodiments, the antibody heavy chain variable region includes wherein the ultralong CDR3 comprises a $X^1X^2X^3X^4X^5X_n(X^aX^b)_z$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q), wherein $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4.

The present disclosure also provides an antibody heavy chain variable region comprising a sequence of the formula V1-X, wherein V1 comprises an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and wherein X comprises an ultralong CDR3, wherein X comprises an ultralong CDR3, which can include a non-human sequence or a non-antibody sequence (e.g., a non-antibody human sequence) that has been inserted into the CDR3 sequence of the antibody, including optionally, removing a portion of CDR3 (e.g., one or more amino acids of the CDR3) or the entire CDR3 sequence (e.g., all or substantially all of the amino acids of the CDR3).

In some embodiments of each or any of the above or below mentioned embodiments, the antibody heavy chain variable region includes wherein the ultralong CDR3 comprises a $X^1X^2X^3X^4X^5$ motif, wherein X1 is threonine (T), glycine (G), alanine (A), serine (S), or valine (V), wherein X2 is serine (S), threonine (T), proline (P), isoleucine (I), alanine (A), valine (V), or asparagine (N), wherein X3 is valine (V), alanine (A), threonine (T), or aspartic acid (D), wherein X4 is histidine (H), threonine (T), arginine (R), tyrosine (Y), phenylalanine (F), or leucine (L), and wherein X5 is glutamine (Q).

In some embodiments of each or any of the above or below mentioned embodiments, the antibody heavy chain variable region includes wherein the X1X2X3X4X5 motif is TTVHQ (SEQ ID NO: 153), TSVHQ (SEQ ID NO: 154), SSVTQ (SEQ ID NO: 155), STVHQ (SEQ ID NO: 156), ATVRQ (SEQ ID NO: 157), TTVYQ (SEQ ID NO: 158), SPVHQ (SEQ ID NO: 159), ATVYQ (SEQ ID NO: 160), TAVYQ (SEQ ID NO: 161), TNVHQ (SEQ ID NO: 162), ATVHQ (SEQ ID NO: 163), STVYQ (SEQ ID NO: 164), TIVHQ (SEQ ID NO: 165), AIVYQ (SEQ ID NO: 166), TTVFQ (SEQ ID NO: 167), AAVFQ (SEQ ID NO: 168), GTVHQ (SEQ ID NO: 169), ASVHQ (SEQ ID NO: 170), TAVFQ (SEQ ID NO: 171), ATVFQ (SEQ ID NO: 172), AAAHQ (SEQ ID NO: 173), VVVYQ (SEQ ID NO: 174), GTVFQ (SEQ ID NO: 175), TAVHQ (SEQ ID NO: 176), ITVHQ (SEQ ID NO: 177), ITAHQ (SEQ ID NO: 178), VTVHQ (SEQ ID NO: 179); AAVHQ (SEQ ID NO: 180), GTVYQ (SEQ ID NO: 181), TTVLQ (SEQ ID NO: 182), TTTHQ (SEQ ID NO: 183), or TTDYQ (SEQ ID NO: 184).

In some embodiments of each or any of the above or below mentioned embodiments, the antibody heavy chain variable region includes wherein the ultralong CDR3 comprises a CX1X2X3X4X5 motif.

In some embodiments of each or any of the above or below mentioned embodiments, the antibody heavy chain variable region includes wherein the CX1X2X3X4X5 motif is CTTVHQ (SEQ ID NO: 185), CTSVHQ (SEQ ID NO: 186), CSSVTQ (SEQ ID NO: 187), CSTVHQ (SEQ ID NO: 188), CATVRQ (SEQ ID NO: 189), CTTVYQ (SEQ ID NO: 190), CSPVHQ (SEQ ID NO: 191), CATVYQ (SEQ ID NO: 192), CTAVYQ (SEQ ID NO: 193), CTNVHQ (SEQ ID NO: 194), CATVHQ (SEQ ID NO: 195), CSTVYQ (SEQ ID NO: 196), CTIVHQ (SEQ ID NO: 197), CAIVYQ (SEQ ID NO: 198), CTTVFQ (SEQ ID NO: 199), CAAVFQ (SEQ ID NO: 200), CGTVHQ (SEQ ID NO: 201), CASVHQ (SEQ ID NO: 202), CTAVFQ (SEQ ID NO: 203), CATVFQ (SEQ ID NO: 204), CAAAHQ (SEQ ID NO: 205), CVVVYQ (SEQ ID NO: 206), CGTVFQ (SEQ ID NO: 207), CTAVHQ (SEQ ID NO: 208), CITVHQ (SEQ ID NO: 209), CITAHQ (SEQ ID NO: 210), CVTVHQ (SEQ ID NO: 211); CAAVHQ (SEQ ID NO: 212), CGTVYQ (SEQ ID NO: 213), CTTVLQ (SEQ ID NO: 214), CTTTHQ (SEQ ID NO: 215), or CTTDYQ (SEQ ID NO: 216).

In some embodiments of each or any of the above or below mentioned embodiments, the antibody heavy chain variable region includes wherein the ultralong CDR3 comprises a (XaXb)z motif, wherein Xa is any amino acid residue, Xb is an aromatic amino acid selected from the group consisting of: tyrosine (Y), phenylalanine (F), tryptophan (W), and histidine (H), and wherein z is 1-4.

In some embodiments of each or any of the above or below mentioned embodiments, the antibody heavy chain variable region includes wherein the (XaXb)z motif is CYTYNYEF (SEQ ID NO: 217), HYTYTYDF (SEQ ID NO: 218), HYTYTYEW (SEQ ID NO: 219), KHRYTYEW (SEQ ID NO: 220), NYIYKYSF (SEQ ID NO: 221), PYIYTYQF (SEQ ID NO: 222), SFTYTYEW (SEQ ID NO: 223), SYIYIYQW (SEQ ID NO: 224), SYNYTYSW (SEQ ID NO: 225), SYSYSYEY (SEQ ID NO: 226), SYTYNYDF (SEQ ID NO: 227), SYTYNYEW (SEQ ID NO: 228), SYTYNYQF (SEQ ID NO: 229), SYVWTHNF (SEQ ID NO: 230), TYKYVYEW (SEQ ID NO: 231), TYTYTYEF (SEQ ID NO: 232), TYTYTYEW (SEQ ID NO: 233), VFTYTYEF (SEQ ID NO: 234), AYTYEW (SEQ ID NO: 235), DYIYTY (SEQ ID NO: 236), IHSYEF (SEQ ID NO: 237), SFTYEF (SEQ ID NO: 238), SHSYEF (SEQ ID NO: 239), THTYEF (SEQ ID NO: 240), TWTYEF (SEQ ID NO: 241), TYNYEW (SEQ ID NO: 242), TYSYEF (SEQ ID NO: 243), TYSYEH (SEQ ID NO: 244), TYTYDF (SEQ ID NO: 245), TYTYEF (SEQ ID NO: 246), TYTYEW (SEQ ID NO: 247), AYEF (SEQ ID NO: 248), AYSF (SEQ ID NO: 249), AYSY (SEQ ID NO: 250), CYSF (SEQ ID NO: 251), DYTY (SEQ ID NO: 252), KYEH (SEQ ID NO: 253), KYEW (SEQ ID NO: 254), MYEF (SEQ ID NO: 255), NWIY (SEQ ID NO: 256), NYDY (SEQ ID NO: 257), NYQW (SEQ ID NO: 258), NYSF (SEQ ID NO: 259), PYEW (SEQ ID NO: 260), RYNW (SEQ ID NO: 261), RYTY (SEQ ID NO: 262), SYEF (SEQ ID NO: 263), SYEH (SEQ ID NO: 264), SYEW (SEQ ID NO: 265), SYKW (SEQ ID NO: 266), SYTY (SEQ ID NO: 267), TYDF (SEQ ID NO: 268), TYEF (SEQ ID NO: 269), TYEW (SEQ ID NO: 270), TYQW (SEQ ID NO: 271), TYTY (SEQ ID NO: 272), or VYEW (SEQ ID NO: 273).

In some embodiments of each or any of the above or below mentioned embodiments, the antibody heavy chain variable region includes wherein the (XaXb)z motif is YXYXYX.

In some embodiments of each or any of the above or below mentioned embodiments, the antibody heavy chain variable region includes wherein the ultralong CDR3 comprises a X1X2X3X4X5Xn motif, wherein X1 is threonine (T), glycine (G), alanine (A), serine (S), or valine (V), wherein X2 is serine (S), threonine (T), proline (P), isoleucine (I), alanine (A), valine (V), or asparagine (N), wherein X3 is valine (V), alanine (A), threonine (T), or aspartic acid (D), wherein X4 is histidine (H), threonine (T), arginine (R), tyrosine (Y), phenylalanine (F), or leucine (L), wherein X5 is glutamine (Q), and wherein n is 27-54.

In some embodiments of each or any of the above or below mentioned embodiments, the antibody heavy chain variable region includes wherein the ultralong CDR3 comprises Xn(XaXb)z motif, wherein Xa is any amino acid residue, Xb is an aromatic amino acid selected from the group consisting of: tyrosine (Y), phenylalanine (F), tryptophan (W), and histidine (H), wherein n is 27-54, and wherein z is 1-4.

In some embodiments of each or any of the above or below mentioned embodiments, the antibody heavy chain variable region includes wherein the ultralong CDR3 comprises a $X^1X^2X^3X^4X^5X_n(X^aX^b)_z$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q), wherein $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4. 206.) The antibody heavy chain variable region includes wherein V1 comprises an amino acid sequence of SEQ ID NO: 737, wherein the ultralong CDR3 comprises an amino acid sequence of SEQ ID NO: 498 and SEQ ID NO: 499, and wherein V2 comprises an amino acid sequence of SEQ ID NO: 500.

In some embodiments of each or any of the above or below mentioned embodiments, the antibody heavy chain variable region includes wherein V 1 comprises an amino acid sequence of SEQ ID NO: 739, wherein the ultralong CDR3 comprises an amino acid sequence of SEQ ID NO: 498 and SEQ ID NO: 499, and wherein V2 comprises an amino acid sequence of SEQ ID NO: 500.

In some embodiments of each or any of the above or below mentioned embodiments, the humanized antibody or binding fragment thereof includes wherein the light chain variable region comprises an amino acid sequence of SEQ ID NO: 750, an amino acid sequence of SEQ ID NO: 754, and an amino acid sequence of SEQ ID NO: 755.

In some embodiments of each or any of the above or below mentioned embodiments, the humanized antibody or binding fragment thereof includes an amino acid sequence of SEQ ID NO: 756.

In some embodiments of each or any of the above or below mentioned embodiments, the humanized antibody or binding fragment thereof includes wherein the light chain variable region comprises an amino acid sequence of SEQ ID NO: 751, an amino acid sequence of SEQ ID NO: 754, and an amino acid sequence of SEQ ID NO: 755.

In some embodiments of each or any of the above or below mentioned embodiments, the humanized antibody or binding fragment thereof includes further comprising an amino acid sequence of SEQ ID NO: 756.

In some embodiments of each or any of the above or below mentioned embodiments, the humanized antibody or binding fragment thereof includes wherein the light chain variable region comprises an amino acid sequence of SEQ ID NO: 752, an amino acid sequence of SEQ ID NO: 754, and an amino acid sequence of SEQ ID NO: 755.

In some embodiments of each or any of the above or below mentioned embodiments, the humanized antibody or binding fragment thereof includes further comprising an amino acid sequence of SEQ ID NO: 756.

In some embodiments of each or any of the above or below mentioned embodiments, the humanized antibody or binding fragment thereof includes wherein the light chain variable region comprises an amino acid sequence of SEQ ID NO: 753, an amino acid sequence of SEQ ID NO: 754, and an amino acid sequence of SEQ ID NO: 755.

In some embodiments of each or any of the above or below mentioned embodiments, the humanized antibody or binding fragment thereof includes further comprising an amino acid sequence of SEQ ID NO: 756.

In some embodiments of each or any of the above or below mentioned embodiments, the humanized antibody or binding fragment thereof includes wherein the heavy chain variable region comprises an amino acid sequence of SEQ ID NO: 737 and SEQ ID NO: 500, wherein the ultralong CDR3 comprises an amino acid sequence of SEQ ID NO: 498 and SEQ ID NO: 499.

In some embodiments of each or any of the above or below mentioned embodiments, the humanized antibody or binding fragment thereof includes further comprising a light chain variable region comprising an amino acid sequence of SEQ ID NO: 750, an amino acid sequence of SEQ ID NO: 754, and an amino acid sequence of SEQ ID NO: 755.

In some embodiments of each or any of the above or below mentioned embodiments, the humanized antibody or binding fragment thereof includes wherein the heavy chain variable region comprises an amino acid sequence of SEQ ID NO: 739 and SEQ ID NO: 500, wherein the ultralong CDR3 comprises an amino acid sequence of SEQ ID NO: 498 and SEQ ID NO: 499.

In some embodiments of each or any of the above or below mentioned embodiments, the humanized antibody or binding fragment thereof includes further comprising a light chain variable region comprising an amino acid sequence of SEQ ID NO: 750, an amino acid sequence of SEQ ID NO: 754, and an amino acid sequence of SEQ ID NO: 755.

BRIEF DESCRIPTION OF THE DRAWINGS

The foregoing summary, as well as the following detailed description of the disclosure, will be better understood when read in conjunction with the appended figures. For the purpose of illustrating the disclosure, shown in the figures are embodiments which are presently preferred. It should be understood, however, that the disclosure is not limited to the precise arrangements, examples and instrumentalities shown.

FIG. 1 shows a sequence alignment of exemplary bovine-derived antibody variable region sequences designated BLV1H12, BLV5B8, BLV5D3, BLV8C11, BF4E9, BF1H1, or F18 that comprise an ultralong CDR3 sequence.

FIG. 2A-C depicts ultralong CDR3 sequences. (Top) Translation from the germline $V_H$BUL, $D_H2$, and $J_H$. The 5 full length ultralong CDR H3s reported in the literature contain between four and eight cysteines and are not highly homologous to one another; however, some conservation of cysteine residues with $D_H2$ could be found when the first cysteine of these CDR H3s was "fixed" prior to alignment. Four of the seven sequences (BLV1H12, BLV5D3, BLV8C11, and BF4E9) contain four cysteines in the same positions as $D_H2$, but also have additional cysteines. BLV5B8 has two cysteines in common with the germline $D_H2$. This limited homology with some cysteine conservation suggests that mutation of $D_H2$ could generate these sequences. B-L1 and B-L2 are from initial sequences from bovine spleen, and the remaining are selected ultralong CDR H3 sequences from deep sequencing data. The first group contains the longest CDR H3s identified, and appear clonally related. The * indicates a sequence represented 167 times, suggesting it was strongly selected for function. Several of the eight-cysteine sequences appear selected for function as they were represented multiple times, indicated in parentheses. Other representative sequences of various lengths are indicated in the last group. The framework cysteine and tryptophan residues that define the CDR H3 boundaries are double-underlined. The sequences BLV1H12 through UL-77 (left-most column) presented in Tables 2A-C are depicted broken apart into four segments to identify the segments of amino acid residues that are derived from certain germline sequences and V/D/J joining sequences. Moving from left to right, the first segment is derived from the $V_H$ germline and is represented in the disclosure as a $X^1X^2X^3X^4X^5$ motif. The second segment represents sequences from V-D joining and is represented in the disclosure as $X_n$. The third segment is a string of amino acid residues derived from $D_H2$ germline, and the fourth segment is a string of amino acid residues derived from $J_H1$ germline region.

FIG. 3 depicts a sequence alignment of exemplary bovine-derived ultralong CDR3 sequences designated BLV1H12, BLV5B8, BLV5D3, BLV8C11, BF4E9, BF1H1, or F18.

FIG. 4 shows an exemplary bovine germline heavy chain variable region (VH) sequence designated VH-UL suitable for modification or use with an ultralong CDR3 sequence.

FIG. 5A-B shows exemplary human germline heavy chain variable region sequences designated 4-39, 4-59*03, 4-34*09, and 4-34*02 that are suitable for modification or use with an ultralong CDR3 sequence (A) and an alignment of these sequences (B).

FIG. 6 shows an exemplary bovine light chain variable region sequence designated BLV1H12 suitable for modification or use with an ultralong CDR 3 sequence (e.g., a heavy chain variable region sequence comprising an ultralong CDR3 sequence).

FIG. 7A-B shows exemplary light chain variable region sequences designated V11-47, V11-40*1, V11-51*01, and V12-18*02 that are suitable for modification or use with an ultralong CDR 3 sequence (A) and an alignment of these sequences (B).

FIG. 8 shows exemplary heavy chain variable region sequences.

FIG. 9 shows exemplary light chain variable region sequences.

FIG. 10 shows exemplary heavy chain variable region sequences having IL-8 non-antibody sequences.

FIG. 11 shows exemplary light chain variable and constant region sequences.

FIG. 12 shows exemplary amino acids sequences.

FIG. 13 shows exemplary nucleic acid Linker-BsaI-Linker sequences introduced into BLV1H12 sequences.

FIG. 14 shows exemplary BLV1H12 heavy chain amino acid sequences with toxin sequences inserted at CDR3 with a variety of linkers.

FIG. 15 shows exemplary amino acids sequences of heavy variable regions and light chains (VL-CL).

FIG. 16 shows exemplary linker amino acid sequences.

FIG. 17 shows exemplary amino acid sequences for toxins.

FIG. 18 shows exemplary nucleic acid sequences for toxins.

FIG. 19 shows exemplary A regions, D regions and V2 regions of variable heavy chains from HIV-1 neutralizing antibodies.

FIG. 20 shows exemplary sodium dodecyl sulfate polyacrylamide gel electrophoresis (SDS-PAGE) of antibody samples (VH4-34 MutE 1×G4S ShK (BID #56) and VH4-34 MutE NoLinker ShK (BID #59)) purified from CHO (e.g., CHO-S) and HEK (e.g., 293F) cells.

FIG. 21 shows exemplary amino acid and nucleic acid sequences for heavy chain variable regions described and referenced herein by BID number, IgG Name and/or Heavy Chain Name.

FIG. 22 shows exemplary amino acid and nucleic acid sequences for light chain variable regions described and referenced herein by BID number, IgG Name and/or Light Chain Name.

DETAILED DESCRIPTION

The present disclosure provides humanized antibodies comprising heavy chain variable regions comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID

Figure 20:
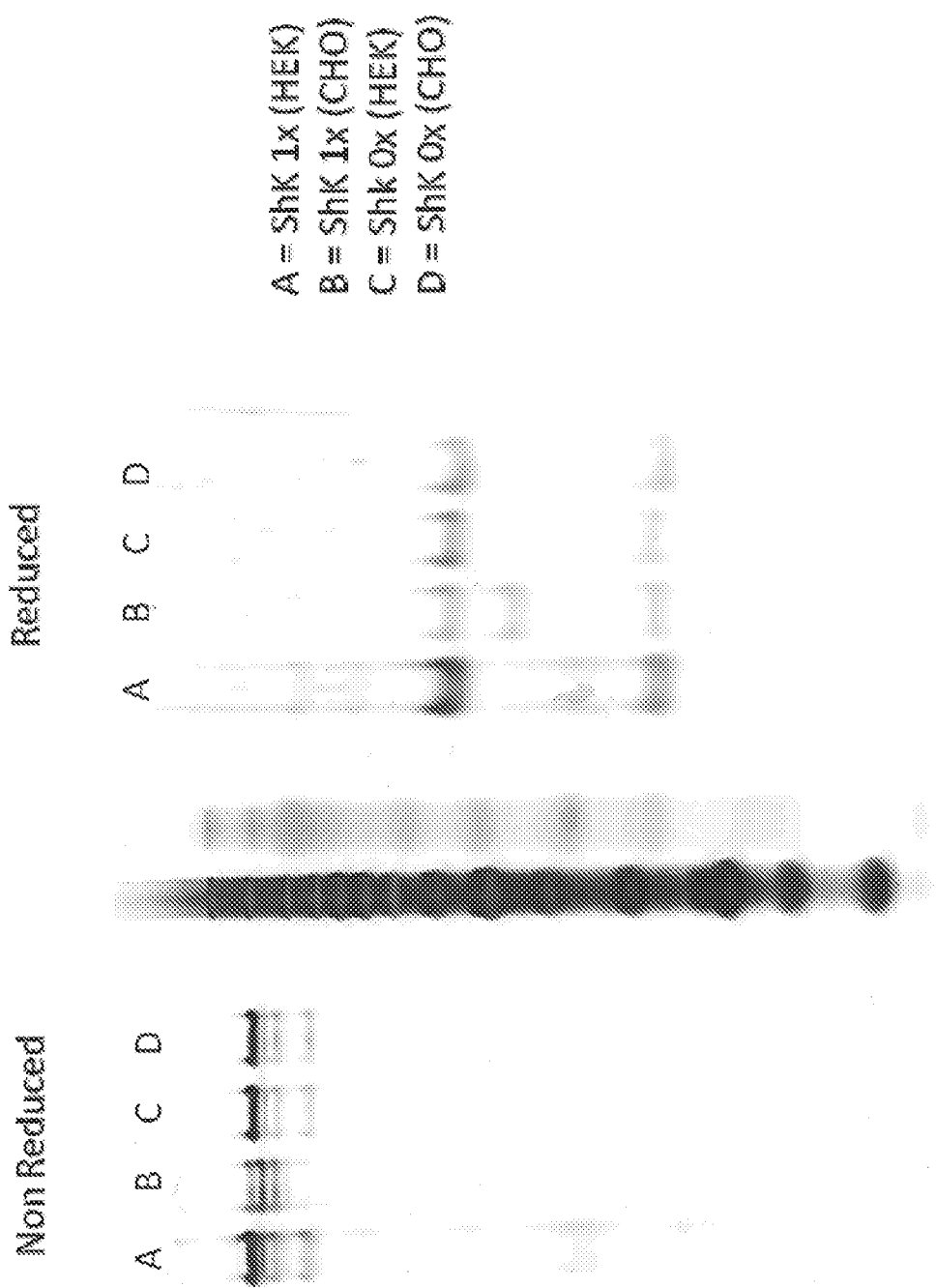

NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3 sequence, along with materials for (e.g., protein sequences, genetic sequences, cells, libraries) and methods of making the antibodies (e.g., humanizing methods, library methods). Such humanized antibodies may be useful for the treatment or prevention of a variety of diseases, disorders, or conditions, including inflammatory diseases, disorders or conditions, autoimmune diseases, disorders or conditions, metabolic diseases, disorders or conditions, neoplastic diseases, disorders or conditions, and cancers.

The present disclosure also provides humanized antibodies comprising heavy chain variable regions comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3 sequence, wherein the CDR3 sequences are 35 amino acids in length or longer (e.g., 40 or longer, 45 or longer, 50 or longer, 55 or longer, 60 or longer) and/or wherein the CDR3 sequences have at least 3 cysteine residues or more (e.g., 3 or more cysteine residues, 4 or more cysteine residues, 5 or more cysteine residues, 6 or more cysteine residues, 7 or more cysteine residues, 8 or more cysteine residues, 9 or more cysteine residues, 10 or more cysteine residues, 11 or more cysteine residues, or 12 or more cysteine residues). Such antibodies, as described herein, bind (e.g., specifically or selectively bind) a variety of targets, including, for example protein targets such as transmembrane proteins (e.g., GPCRs, ion channels, transporter, cell surface receptors).

The present disclosure also provides methods and materials for the preparation or making of humanized antibodies comprising heavy chain variable regions comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3 sequence. Such materials include proteins, genetic sequences, cells and libraries. Such methods include methods of humanization and method of making and screening libraries.

The present disclosure provides a humanized antibody or binding fragment thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3. In some embodiments, the ultralong CDR3 may be 35 amino acids in length or longer, 40 amino acids in length or longer, 45 amino acids in length or longer, 50 amino acids in length or longer, 55 amino acids in length or longer, or 60 amino acids in length or longer.

In some embodiments, the ultralong CDR3 may comprise 3 or more cysteine residues, 4 or more cysteine residues, 5 or more cysteine residues, 6 or more cysteine residues, 7 or more cysteine residues, 8 or more cysteine residues, 9 or more cysteine residues, 10 or more cysteine residues, 11 or more cysteine residues, or 12 or more cysteine residues. The ultralong CDR3 may comprise a cysteine motif including, for example, where the cysteine motif is selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_8C$ (SEQ ID NO: 46), $CX_{10}CX_6CX_6CXCX_7C$ (SEQ ID NO: 47), $CX_{10}CX_4CX_7CXCX_8C$ (SEQ ID NO: 48), $CX_{10}CX_4CX_7CXCX_7C$ (SEQ ID NO: 49), $CX_{13}CX_8CX_8C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CX_5CXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_8CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CX_5CX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CX_5CX_7CXCX_6C$ (SEQ ID NO: 76), $CX_{10}CX_4CX_5CX_{12}CX_2C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_8CX_6C$ (SEQ ID NO: 82), $CX_{12}CX_4CX_5CX_8CX_2C$ (SEQ ID NO: 83), $CX_{12}CX_5CX_5CXCX_8C$ (SEQ ID NO: 84), $CX_{10}CX_6CX_5CXCX_4CXCX_9C$ (SEQ ID NO: 85), $CX_{11}CX_4CX_5CX_8CX_2C$ (SEQ ID NO: 86), $CX_{10}CX_6CX_5CX_8CX_2C$ (SEQ ID NO: 87), $CX_{10}CX_6CX_5CXCX_8C$ (SEQ ID NO: 88), $CX_{10}CX_6CX_5CXCX_3CXCX_2C$ (SEQ ID NO: 89), $CX_{10}CX_6CX_5CX_3CX_8C$ (SEQ ID NO: 90), $CX_{10}CX_6CX_5CXCX_2CX_6CX_5C$ (SEQ ID NO: 91), $CX_7CX_6CX_2CX_3CX_9C$ (SEQ ID NO: 92), $CX_9CX_8CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95). Alternatively, the ultralong CDR3 may comprise a cysteine motif including, for example, where the cysteine motif is selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_6CX_3CXCX_2CXCCCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_8CX_5CX_4CX_3CX_4CCXCX_1C$ (SEQ ID NO: 103), $CCX_6CCX_5CCCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_3CX_3C$ (SEQ ID NO: 112), $CX_8CCXCX_3CCX_3CXCX_3CX_4C$ (SEQ ID NO: 113), $CX_9CCX_4CX_2CXCCXCX_4CX_3C$ (SEQ ID NO: 114), $CX_{10}CXCX_3CX_2CXCCX_4CX_5CXC$ (SEQ ID NO: 115), $CX_9CXCX_3CX_2CXCCX_4CX_5CXC$ (SEQ ID NO: 116), $CX_6CCXCX_5CX_4CCXCX_5CX_2C$ (SEQ ID NO: 117), $CX_6CCXCX_3CXCCX_3CX_4CC$ (SEQ ID NO: 118), $CX_6CCXCX_3CXCX_2CXCX_4CXC$ (SEQ ID NO: 119), $CX_4CX_2CCX_3CXCX_4CCX_2CX_3C$ (SEQ ID NO: 120), $CX_3CX_5CX_3CCCX_4CX_9C$ (SEQ ID NO: 121), $CCX_9CX_3CXCCX_3CX_5C$ (SEQ ID NO: 122), $CX_9CX_2CX_3CX_4CCX_4CX_5C$ (SEQ ID NO: 123), $CX_9CX_7CX_4CCXCX_7CX_3C$ (SEQ ID NO: 124), $CX_9CX_3CCCX_{10}CX_2CX_3C$ (SEQ ID NO: 125), $CX_3CX_5CX_5CX_4CCXCX_6C$ (SEQ ID NO: 126), $CX_9CX_5CX_4CCXCX_5CX_4C$ (SEQ ID NO: 127), $CX_7CXCX_6CX_4CCCX_{10}C$ (SEQ ID NO: 128), $CX_8CX_2CX_4CCX_4CX_3CX_3C$ (SEQ ID NO: 129), $CX_7CX_5CXCX_4CCX_7CX_4C$ (SEQ ID NO: 130), $CX_{11}CX_3CX_4CCCX_8CX_2C$ (SEQ ID NO: 131), $CX_2CX_3CX_4CCX_4CX_5CX_{15}C$ (SEQ ID NO: 132), $CX_9CX_5CX_4CCX_7C$ (SEQ ID NO: 133), $CX_9CX_7CX_3CX_2CX_6C$ (SEQ ID NO: 134), $CX_9CX_5CX_4CCX_{14}C$ (SEQ ID NO: 135), $CX_9CX_5CX_4CCX_8C$ (SEQ ID NO: 136), $CX_9CX_6CX_4CCXC$ (SEQ ID NO: 137), $CX_5CCX_7CX_4CX_{12}$ (SEQ ID NO: 138), $CX_{10}CX_3CX_4CCX_4C$ (SEQ ID NO: 139), $CX_9CX_4CCX_5CX_4C$ (SEQ ID NO: 140), $CX_{10}CX_3CX_4CX_7CXC$ (SEQ ID NO: 141), $CX_7CX_7CX_2CX_2CX_3C$ (SEQ ID NO: 142), $CX_9CX_4CX_4CCX_6C$ (SEQ ID NO: 143), $CX_7CXCX_3CXCX_6C$ (SEQ ID NO: 144), $CX_7CXCX_4CXCX_4C$ (SEQ ID NO: 145), $CX_9CX_5CX_4C$ (SEQ ID NO: 146), $CX_3CX_6CX_8C$ (SEQ ID NO: 147), $CX_{10}CXCX_4C$ (SEQ ID NO: 148), $CX_{10}CCX_4C$ (SEQ ID NO: 149), $CX_{15}C$ (SEQ ID NO: 150), $CX_{10}C$ (SEQ ID NO: 151), and $CX_9C$ (SEQ ID NO: 152).

The present disclosure provides a humanized antibody or binding fragment thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3, wherein the ultralong CDR3 comprises a $X^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q). In some embodiments, the $X^1X^2X^3X^4X^5$ motif may be TTVHQ (SEQ ID NO: 153), TSVHQ (SEQ ID NO: 154), SSVTQ (SEQ ID NO: 155), STVHQ (SEQ ID NO: 156), ATVRQ (SEQ ID NO: 157), TTVYQ (SEQ ID NO: 158), SPVHQ (SEQ ID NO: 159), ATVYQ (SEQ ID NO: 160), TAVYQ (SEQ ID NO: 161), TNVHQ (SEQ ID NO: 162), ATVHQ (SEQ ID NO: 163), STVYQ (SEQ ID NO: 164), TIVHQ (SEQ ID NO: 165), AIVYQ (SEQ ID NO: 166), TTVFQ (SEQ ID NO: 167), AAVFQ (SEQ ID NO: 168), GTVHQ (SEQ ID NO: 169), ASVHQ (SEQ ID NO: 170), TAVFQ (SEQ ID NO: 171), ATVFQ (SEQ ID NO: 172), AAAHQ (SEQ ID NO: 173), VVVYQ (SEQ ID NO: 174), GTVFQ (SEQ ID NO: 175), TAVHQ (SEQ ID NO: 176), ITVHQ (SEQ ID NO: 177), ITAHQ (SEQ ID NO: 178), VTVHQ (SEQ ID NO: 179); AAVHQ (SEQ ID NO: 180), GTVYQ (SEQ ID NO: 181), TTVLQ (SEQ ID NO: 182), TTTHQ (SEQ ID NO: 183), or TTDYQ (SEQ ID NO: 184).

The present disclosure provides a humanized antibody or binding fragment thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3, wherein the ultralong CDR3 comprises a $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4. In some embodiments, the $(X^aX^b)_z$ motif may be CYTYNYEF (SEQ ID NO: 217), HYTYTYDF (SEQ ID NO: 218), HYTYTYEW (SEQ ID NO: 219), KHRYTYEW (SEQ ID NO: 220), NYIYKYSF (SEQ ID NO: 221), PYIYTYQF (SEQ ID NO: 222), SFTYTYEW (SEQ ID NO: 223), SYIYIYQW (SEQ ID NO: 224), SYNYTYSW (SEQ ID NO: 225), SYSYSYEY (SEQ ID NO: 226), SYTYNYDF (SEQ ID NO: 227), SYTYNYEW (SEQ ID NO: 228), SYTYNYQF (SEQ ID NO: 229), SYVWTHNF (SEQ ID NO: 230), TYKYVYEW (SEQ ID NO: 231), TYTYTYEF (SEQ ID NO: 232), TYTYTYEW (SEQ ID NO: 233), VFTYTYEF (SEQ ID NO: 234), AYTYEW (SEQ ID NO: 235), DYIYTY (SEQ ID NO: 236), IHSYEF (SEQ ID NO: 237), SFTYEF (SEQ ID NO: 238), SHSYEF (SEQ ID NO: 239), THTYEF (SEQ ID NO: 240), TWTYEF (SEQ ID NO: 241), TYNYEW (SEQ ID NO: 242), TYSYEF (SEQ ID NO: 243), TYSYEH (SEQ ID NO: 244), TYTYDF (SEQ ID NO: 245), TYTYEF (SEQ ID NO: 246), TYTYEW (SEQ ID NO: 247), AYEF (SEQ ID NO: 248), AYSF (SEQ ID NO: 249), AYSY (SEQ ID NO: 250), CYSF (SEQ ID NO: 251), DYTY (SEQ ID NO: 252), KYEH (SEQ ID NO: 253), KYEW (SEQ ID NO: 254), MYEF (SEQ ID NO: 255), NWIY (SEQ ID NO: 256), NYDY (SEQ ID NO: 257), NYQW (SEQ ID NO: 258), NYSF (SEQ ID NO: 259), PYEW (SEQ ID NO: 260), RYNW (SEQ ID NO: 261), RYTY (SEQ ID NO: 262), SYEF (SEQ ID NO: 263), SYEH (SEQ ID NO: 264), SYEW (SEQ ID NO: 265), SYKW (SEQ ID NO: 266), SYTY (SEQ ID NO: 267), TYDF (SEQ ID NO: 268), TYEF (SEQ ID NO: 269), TYEW (SEQ ID NO: 270), TYQW (SEQ ID NO: 271), TYTY (SEQ ID NO: 272), or VYEW (SEQ ID NO: 273).

The present disclosure provides a humanized antibody or binding fragment thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3, wherein the ultralong CDR3 comprises a $X^1X^2X^3X^4X^5X_n(X^aX^b)_z$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q), wherein $X^a$ is any amino acid residue, $X^b$ is an aromatic amino acid selected from the group consisting of: tyrosine (Y), phenylalanine (F), tryptophan (W), and histidine (H), wherein n is 27-54, and wherein z is 1-4.

The present disclosure provides a humanized antibody or binding fragment thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3, wherein the ultralong CDR3 comprises: a $CX^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q), a cysteine motif selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_8C$ (SEQ ID NO: 46), $CX_{10}CX_6CX_6CXCX_7C$ (SEQ ID NO: 47), $CX_{10}CX_4CX_7CXCX_8C$ (SEQ ID NO: 48), $CX_{10}CX_4CX_7CXCX_7C$ (SEQ ID NO: 49), $CX_{13}CX_8CX_8C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CX_5CXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_8CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CX_5CX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CX_5CX_7CXCX_6C$ (SEQ ID NO: 76), $CX_{10}CX_4CX_5CX_{12}CX_2C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_8CX_6C$ (SEQ ID NO: 82), $CX_{12}CX_4CX_5CX_8CX_2C$ (SEQ ID NO: 83), $CX_{12}CX_5CX_5CXCX_8C$ (SEQ ID NO: 84), $CX_{10}CX_6CXCXCX_4CXCX_9C$ (SEQ ID NO: 85), $CX_{11}CX_4CX_5CX_8CX_2C$ (SEQ ID NO: 86), $CX_{10}CX_6CX_5CX_8CX_2C$ (SEQ ID NO: 87), $CX_{10}CX_6CX_5CXCX_8C$ (SEQ ID NO: 88), $CX_{10}CX_6CX_5CXCX_3CX_8CX_2C$ (SEQ ID NO: 89), $CX_{10}CX_6CX_5CX_3CX_8C$ (SEQ ID NO: 90), $CX_{10}CX_6CX_5CXCX_2CX_6CX_5C$ (SEQ ID NO: 91), $CX_7CX_6CX_3CX_3CX_9C$ (SEQ ID NO: 92), $CX_9CX_8CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95), and a $(X^aX^b)_z$ motif, wherein $X^a$ is any amino acid residue, $X^b$ is an aromatic amino acid selected from the group consisting of: tyrosine (Y), phenylalanine (F), tryptophan (W), and histidine (H), and wherein z is 1-4.

The present disclosure provides a humanized antibody or binding fragment thereof comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3, wherein the ultralong CDR3 comprises: a $CX^1X^2X^3X^4X^5$ motif, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q); a cysteine motif selected from the group consisting of: wherein the cysteine motif is selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_5CX_3CXCX_4CX_4CCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_8CX_5CX_4CX_3CX_4CCXCX_1C$ (SEQ ID NO: 103), $CCX_6CCX_5CCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCXCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_3CX_3C$ (SEQ ID NO: 112), $CX_8CCXCX_3CCX_3CXCX_3CX_4C$ (SEQ ID NO: 113), $CX_9CCX_4CX_2CXCCXCX_4CX_3C$ (SEQ ID NO: 114), $CX_{10}CXCX_3CX_2CXCCX_4CX_5CXC$ (SEQ ID NO: 115), $CX_9CXCX_3CX_2CXCCX_4CX_5CXC$ (SEQ ID NO: 116), $CX_6CCXCX_5CX_4CCXCX_5CX_2C$ (SEQ ID NO: 117), $CX_6CCXCX_3CXCX_3CX_4CC$ (SEQ ID NO: 118), $CX_6CCXCX_3CXCX_2CXCX_4CX_8C$ (SEQ ID NO: 119), $CX_4CX_2CCX_3CXCX_4CCX_2CX_3C$ (SEQ ID NO: 120), $CX_3CX_5CX_3CCCX_4CX_9C$ (SEQ ID NO: 121), CCX$_9$CX$_3$CXCCX$_3$CX$_5$C (SEQ ID NO: 122), CX$_9$CX$_2$CX$_3$CX$_4$CCX$_4$CX$_5$C (SEQ ID NO: 123), CX$_9$CX$_7$CX$_4$CCXCX$_7$CX$_3$C (SEQ ID NO: 124), CX$_9$CX$_3$CCCX$_{10}$CX$_2$CX$_3$C (SEQ ID NO: 125), CX$_3$CX$_5$CX$_5$CX$_4$CCX$_{10}$CX$_6$C (SEQ ID NO: 126), CX$_9$CX$_5$CX$_4$CCXCX$_5$CX$_4$C (SEQ ID NO: 127), CX$_7$CXCX$_6$CX$_4$CCCX$_{10}$C (SEQ ID NO: 128), CX$_8$CX$_2$CX$_4$CCX$_4$CX$_3$CX$_3$C (SEQ ID NO: 129), CX$_7$CX$_5$CXCX$_4$CCX$_7$CX$_4$C (SEQ ID NO: 130), CX$_{11}$CX$_3$CX$_4$CCCX$_8$CX$_2$C (SEQ ID NO: 131), CX$_2$CX$_3$CX$_4$CCX$_4$CX$_5$CX$_{15}$C (SEQ ID NO: 132), CX$_9$CX$_5$CX$_4$CCX$_7$C (SEQ ID NO: 133), CX$_9$CX$_7$CX$_3$CX$_2$CX$_6$C (SEQ ID NO: 134), CX$_9$CX$_5$CX$_4$CCX$_{14}$C (SEQ ID NO: 135), CX$_9$CX$_5$CX$_4$CCXC (SEQ ID NO: 136), CX$_9$CX$_6$CX$_4$CCXC (SEQ ID NO: 137), CX$_5$CCX$_7$CX$_4$CX$_{12}$ (SEQ ID NO: 138), CX$_{10}$CX$_3$CX$_4$CCX$_4$C (SEQ ID NO: 139), CX$_9$CX$_4$CCX$_5$CX$_4$C (SEQ ID NO: 140), CX$_{10}$CX$_3$CX$_4$CX$_7$CXC (SEQ ID NO: 141), CX$_7$CX$_7$CX$_2$CX$_2$CX$_3$C (SEQ ID NO: 142), CX$_9$CX$_4$CX$_4$CCX$_6$C (SEQ ID NO: 143), CX$_7$CXCX$_3$CXCX$_6$C (SEQ ID NO: 144), CX$_7$CXCX$_4$CXCX$_4$C (SEQ ID NO: 145), CX$_9$CX$_5$CX$_4$C (SEQ ID NO: 146), CX$_3$CX$_6$CX$_8$C (SEQ ID NO: 147), CX$_{10}$CXCX$_4$C (SEQ ID NO: 148), CX$_{10}$CCX$_4$C (SEQ ID NO: 149), CX$_{15}$C (SEQ ID NO: 150), CX$_{10}$C (SEQ ID NO: 151), and CX$_9$C (SEQ ID NO: 152); and a (X$^a$X$^b$)$_z$ motif, wherein X$^a$ is any amino acid residue, X$^b$ is an aromatic amino acid selected from the group consisting of: tyrosine (Y), phenylalanine (F), tryptophan (W), and histidine (H), and wherein z is 1-4.

The present disclosure also provides methods of generating a library of humanized antibodies that comprises an ultralong CDR3, comprising: combining a nucleic acid sequence encoding an ultralong CDR3 with a nucleic acid sequence encoding a human variable region framework (FR) sequence to produce nucleic acids encoding for humanized antibodies that comprises an ultralong CDR3; and expressing the nucleic acids encoding for humanized antibodies that comprises an ultralong CDR3 to generate a library of humanized antibodies that comprises an ultralong CDR3.

The present disclosure also provides methods of generating a library of humanized antibodies or binding fragments thereof comprising an ultralong CDR3 that comprises a non-antibody sequence, comprising: combining a nucleic acid sequence encoding an ultralong CDR3, a nucleic acid sequence encoding a human variable region framework (FR) sequence, and a nucleic acid sequence encoding a non-antibody sequence to produce nucleic acids encoding humanized antibodies or binding fragments thereof comprising an ultralong CDR3 and a non-antibody sequence, and expressing the nucleic acids encoding humanized antibodies or binding fragments thereof comprising an ultralong CDR3 and a non-antibody sequence to generate a library of humanized antibodies or binding fragments thereof comprising an ultralong CDR3 and a non-antibody sequence.

The present disclosure also provides libraries of humanized antibodies or binding fragments thereof comprising an ultralong CDR3 that comprises a non-antibody sequence.

The present disclosure also provides methods of generating a library of humanized antibodies or binding fragments thereof comprising an ultralong CDR3 that comprises a cysteine motif, comprising: combining a human variable region framework (FR) sequence, and a nucleic acid sequence encoding an ultralong CDR3 and a cysteine motif; introducing one or more nucleotide changes to the nucleic acid sequence encoding one or more amino acid residues that are positioned between one or more cysteine residues in the cysteine motif for nucleotides encoding different amino acid residues to produce nucleic acids encoding humanized antibodies or binding fragments thereof comprising an ultralong CDR3 and a cysteine motif with one or more nucleotide changes introduced between one or more cysteine residues in the cysteine domain; and expressing the nucleic acids encoding humanized antibodies or binding fragments thereof comprising an ultralong CDR3 and a cysteine motif with one or more nucleotide changes introduced between one or more cysteine residues in the cysteine domain to generate a library of humanized antibodies or binding fragments thereof comprising an ultralong CDR3 and a cysteine motif with one or more amino acid changes introduced between one or more cysteine residues in the cysteine domain.

The present disclosure also provides libraries of humanized antibodies or binding fragments thereof comprising an ultralong CDR3 that comprises a cysteine motif, wherein the antibodies or binding fragments comprise one or more substitutions of amino acid residues that are positioned between cysteine residues in the cysteine motif.

The present disclosure also provides methods of generating a library of humanized antibodies or binding fragments thereof comprising a bovine ultralong CDR3, comprising: combining a nucleic acid sequence encoding a human variable region framework (FR) sequence and a nucleic acid encoding a bovine ultralong CDR3, and expressing the nucleic acids encoding a human variable region framework (FR) sequence and a nucleic acid encoding a bovine ultralong CDR3 to generate a library of humanized antibodies or binding fragments thereof comprising a bovine ultralong CDR3.

Proteins

The present disclosure provides humanized antibodies comprising heavy chain variable regions comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3 sequence.

In an embodiment, the present disclosure provides a humanized antibody comprising an ultralong CDR3, wherein the CDR3 is 35 amino acids in length or more (e.g., 40 or more, 45 or more, 50 or more, 55 or more, 60 or more). Such a humanized antibody may comprise at least 3 cysteine residues or more (e.g., 4 or more, 6 or more, 8 or more) within the ultralong CDR3.

In another embodiment, the present disclosure provides a humanized antibody comprising an ultralong CDR3, wherein the CDR3 is 35 amino acids in length or more and is derived from or based on a non-human sequence. The ultralong CDR3 sequence may be derived from any species that naturally produces ultralong CDR3 antibodies, including ruminants such as cattle (Bos taurus).

In another embodiment, the present disclosure provides a humanized antibody comprising an ultralong CDR3, wherein the CDR3 is 35 amino acids in length or more and is derived from a non-antibody sequence. The non-antibody sequence may be derived from any protein family including, but not limited to, chemokines, growth factors, peptides, cytokines, cell surface proteins, serum proteins, toxins, extracellular matrix proteins, clotting factors, secreted proteins, etc. The non-antibody sequence may be of human or non-human origin and may comprise a portion of a non-antibody protein such as a peptide or domain. The non-antibody sequence of an ultralong CDR3 may contain mutations from its natural sequence, including amino acid changes (e.g., substitutions), insertions or deletions. Engineering additional amino acids at the junction between the non-antibody sequence may be done to facilitate or enhance proper folding of the non-antibody sequence within the humanized antibody.

In another embodiment, the present disclosure provides a humanized antibody comprising an ultralong CDR3, wherein the CDR3 is 35 amino acids in length or more and comprises at least 3 cysteine residues or more, including, for example, 4 or more, 6 or more, and 8 or more.

In another embodiment, the present disclosure provides for a humanized antibody comprising an ultralong CDR3 wherein the CDR3 is 35 amino acids in length or more and comprises at least 3 cysteine residues or more and wherein the ultralong CDR3 is a component of a multispecific antibody. The multispecific antibody may be bispecific or comprise greater valencies.

In another embodiment, the present disclosure provides a humanized antibody comprising an ultralong CDR3, wherein the CDR3 is 35 amino acids in length or more and comprises at least 3 cysteine residues or more, wherein the partially human ultralong CDR3 is a component of an immunoconjugate.

In another embodiment, the present disclosure provides a humanized antibody comprising an ultralong CDR3, wherein the CDR3 is 35 amino acids in length or more and comprises at least 3 cysteine residues or more, wherein the humanized antibody comprising an ultralong CDR3 binds to a transmembrane protein target. Such transmembrane targets may include, but are not limited to, GPCRs, ion channels, transporters, and cell surface receptors.

Genetic Sequences

The present disclosure provides genetic sequences (e.g., genes, nucleic acids, polynucleotides) encoding humanized antibodies comprising a heavy chain variable region comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3 sequence.

The present disclosure also provides genetic sequences (e.g., genes, nucleic acids, polynucleotides) encoding an ultralong CDR3.

In an embodiment, the present disclosure provides genetic sequences encoding a humanized antibody comprising an ultralong CDR3, wherein the CDR3 is 35 amino acids in length or more (e.g., 40 or more, 45 or more, 50 or more, 55 or more, 60 or more). Such a humanized antibody may comprise at least 3 cysteine residues or more (e.g., 4 or more, 6 or more, 8 or more) within the ultralong CDR3.

In another embodiment, the present disclosure provides genetic sequences encoding a humanized antibody comprising an ultralong CDR3, wherein the CDR3 is 35 amino acids in length or more and is derived from or based on a non-human sequence. The genetic sequences encoding the ultralong CDR3 may be derived from any species that naturally produces ultralong CDR3 antibodies, including ruminants such as cattle (*Bos taurus*).

In another embodiment, the present disclosure provides genetic sequences encoding a humanized antibody comprising an ultralong CDR3, wherein the CDR3 is 35 amino acids in length or more and is derived from a non-antibody protein sequence. The genetic sequences encoding the non-antibody protein sequences may be derived from any protein family including, but not limited to, chemokines, growth factors, peptides, cytokines, cell surface proteins, serum proteins, toxins, extracellular matrix proteins, clotting factors, secreted proteins, etc. The non-antibody protein sequence may be of human or non-human origin and may comprise a portion of a non-antibody protein such as a peptide or domain. The non-antibody protein sequence of an ultralong CDR3 may contain mutations from its natural sequence, including amino acid changes (e.g., substitutions), insertions or deletions. Engineering additional amino acids at the junction between the non-antibody sequence may be done to facilitate or enhance proper folding of the non-antibody sequence within the humanized antibody.

In another embodiment, the present disclosure provides genetic sequences encoding a humanized antibody comprising an ultralong CDR3, wherein the CDR3 is 35 amino acids in length or more and comprises at least 3 cysteine residues or more, including, for example, 4 or more, 6 or more, and 8 or more.

In another embodiment, the present disclosure provides genetic sequences encoding a humanized antibody comprising an ultralong CDR3 wherein the CDR3 is 35 amino acids in length or more and comprises at least 3 cysteine residues or more and wherein the ultralong CDR3 is a component of a multispecific antibody. The multispecific antibody may be bispecific or comprise greater valencies.

In another embodiment, the present disclosure provides genetic sequences encoding a humanized antibody comprising an ultralong CDR3, wherein the CDR3 is 35 amino acids in length or more and comprises at least 3 cysteine residues or more, wherein the ultralong CDR3 is a component of an immunoconjugate.

In another embodiment, the present disclosure provides genetic sequences encoding a humanized antibody comprising an ultralong CDR3 wherein the CDR3 is 35 amino acids in length or more and comprises at least 3 cysteine residues or more and wherein the humanized antibody comprising an ultralong CDR3 binds to a transmembrane protein target.

Such transmembrane targets may include, but are not limited to, GPCRs, ion channels, transporters, and cell surface receptors.

Libraries and Arrays

The present disclosure provides collections, libraries, and arrays of humanized antibodies comprising ultralong CDR3 sequences.

In an embodiment, the present disclosure provides a library or an array of humanized antibodies comprising ultralong CDR3 sequences wherein at least two members of the library or array differ in the positions of at least one of the cysteines in the ultralong CDR3 sequence. Structural diversity may be enhanced through different numbers of cysteines in the ultralong CDR3 sequence (e.g., at least 3 or more cysteine residues such as 4 or more, 6 or more and 8 or more) and/or through different disulfide bond formation, and hence different loop structures.

In another embodiment, the present disclosure provides for a library or an array of humanized antibodies comprising ultralong CDR3 sequences wherein at least two members of the library or the array differ in at least one amino acid located between cysteines in the ultralong CDR3. In this regard, members of the library or the array can contain cysteines in the same positions of CDR3, resulting in similar overall structural folds, but with fine differences brought about through different amino acid side chains. Such libraries or arrays may be useful for affinity maturation.

In another embodiment, the present disclosure provides libraries or arrays of humanized antibodies comprising ultralong CDR3 sequences wherein at least two of the ultralong CDR3 sequences differ in length (e.g., 35 amino acids in length or more such as 40 or more, 45 or more, 50 or more, 55 or more and 60 or more). The amino acid and cysteine content may or may not be altered between the members of the library or the array. Different lengths of ultralong CDR3 sequences may provide for unique binding sites, including, for example, due to steric differences, as a result of altered length.

In another embodiment, the present disclosure provides libraries or arrays of humanized antibodies comprising ultralong CDR3 sequences wherein at least two members of the library differ in the human framework used to construct the humanized antibody comprising an ultralong CDR3.

In another embodiment, the present disclosure provides libraries or arrays of humanized antibodies comprising ultralong CDR3 sequences wherein at least two members of the library or the array differ in having a non-antibody protein sequence that comprises a portion of the ultralong CDR3. Such libraries or arrays may contain multiple non-antibody protein sequences, including for chemokines, growth factors, peptides, cytokines, cell surface proteins, serum proteins, toxins, extracellular matrix proteins, clotting factors, secreted proteins, viral or bacterial proteins, etc. The non-antibody protein sequence may be of human or non-human origin and may be comprised of a portion of a non-antibody protein such as a peptide or domain. The non-antibody protein sequence of the ultralong CDR3 may contain mutations from its natural sequence, including amino acid changes (e.g., substitutions), or insertions or deletions. Engineering additional amino acids at the junction between the non-antibody sequence within the ultralong CDR3 may be done to facilitate or enhance proper folding of the non-antibody sequence within the humanized antibody.

The libraries or the arrays of the present disclosure may be in several formats well known in the art. The library or the array may be an addressable library or an addressable array. The library or array may be in display format, for example, the antibody sequences may be expressed on phage, ribosomes, mRNA, yeast, or mammalian cells.

Cells

The present disclosure provides cells comprising genetic sequences encoding humanized antibodies comprising heavy chain variable regions comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3 sequence.

In an embodiment, the present disclosure provides cells expressing a humanized antibody comprising an ultralong CDR3. The cells may be prokaryotic or eukaryotic, and a humanized antibody comprising an ultralong CDR3 may be expressed on the cell surface or secreted into the media. When displayed on the cell surface a humanized antibody preferentially contains a motif for insertion into the plasmid membrane such as a membrane spanning domain at the C-terminus or a lipid attachment site. For bacterial cells, a humanized antibody comprising an ultralong CDR3 may be secreted into the periplasm. When the cells are eukaryotic, they may be transiently transfected with genetic sequences encoding a humanized antibody comprising an ultralong CDR3. Alternatively, a stable cell line or stable pools may be created by transfecting or transducing genetic sequences encoding a humanized antibody comprising an ultralong CDR3 by methods well known to those of skill in the art. Cells can be selected by fluorescence activated cell sorting (FACS) or through selection for a gene encoding drug resistance. Cells useful for producing humanized antibodies comprising ultralong CDR3 sequences include prokaryotic cells like *E. coli*, eukaryotic cells like the yeasts *Saccharomyces cerevisiae* and *Pichia pastoris*, chinese hamster ovary (CHO) cells, monkey cells like COS-1, or human cells like HEK-293, HeLa, SP-1.

Humanization Methods

The present disclosure provides methods for making humanized antibodies comprising ultralong CDR3 sequences, comprising the steps of engineering an ultralong CDR3 sequence derived from a non-human CDR3 into a human framework. The human framework may be of germline origin, or may be derived from non-germline (e.g. mutated or affinity matured) sequences. Genetic engineering techniques well known to those in the art, including as disclosed herein, may be used to generate a hybrid DNA sequence containing a human framework and a non-human ultralong CDR3. Unlike human antibodies which may be encoded by V region genes derived from one of seven families, bovine antibodies which produce ultralong CDR3 sequences appear to utilize a single V region family which may be considered to be most homologous to the human VH4 family. In a preferred embodiment where ultralong CDR3 sequences derived from cattle are to be humanized to produce an antibody comprising an ultralong CDR3, human V region sequences derived from the VH4 family may be genetically fused to a bovine-derived ultralong CDR3 sequence. Exemplary VH4 germline gene sequences in the human antibody locus are shown in FIG. 5A (e.g., SEQ ID NOS: 31-34; and 368-371).

The present disclosure also provides methods of humanizing an antibody variable region comprising the step of genetically combining a nucleic acid sequence encoding a non-human ultralong CDR3 (ULCDR3) with a nucleic acid sequence encoding a human variable region framework (FR) sequence. Also provided are methods of making a humanized antibody variable region comprising selecting a human framework sequence comprising FR1, FR2, and FR3; selecting a CDR1 sequence; selecting a CDR2 sequence; selecting an ultralong CDR3 sequence; and combining the sequences as FR1-CDR1-FR2-CDR2-FR3-ULCDR3. Also provided are methods of making a humanized antibody variable region sequence comprising selecting a human antibody variable region sequence comprising a sequence encoding FR1-CDR1-FR2-CDR2-FR3; selecting a sequence encoding a non-human ultralong CDR3 (ULCDR3); and genetically fusing the human sequence of step (a) in frame with the non-human sequence of step (b) to generate a sequence encoding FR1-CDR1-FR2-CDR2-FR3-ULCDR3.

In an embodiment, the present disclosure provides a fusion of a human VH4 framework sequence to a bovine-derived ultralong CDR3, for example, as may be accomplished through the following steps. First, the second cysteine of a V region genetic sequence is identified along with the nucleotide sequence encoding the second cysteine. Generally, the second cysteine marks the boundary of the framework and CDR3 two residues upstream (N-terminal) of the CDR3. Second, the second cysteine in a bovine-derived V region sequence is identified which similarly marks 2 residues upstream (N-terminal) of the CDR3. Third, the genetic material encoding the human V region is combined with the genetic sequence encoding the ultralong CDR3. Thus, a genetic fusion may be made, wherein the ultralong CDR3 sequence is placed in frame of the human V region sequence. Preferably a humanized antibody comprising an ultralong CDR3 is as near to human in amino acid composition as possible. Optionally, a J region sequence may be mutated from bovine-derived sequence to a human sequence. Also optionally, a humanized heavy chain may be paired with a human light chain.

In another embodiment, the present disclosure provides pairing of a human ultralong CDR3 heavy chain with a non-human light chain.

In another embodiment, the present disclosure provides pairing of a humanized heavy chain comprising an ultralong CDR3 with a human light chain. Preferably the light chain is homologous to a bovine light chain known to pair with a bovine ultralong CDR3 heavy chain. An exemplary bovine light chain is shown in FIG. 7A (e.g., SEQ ID NO: 36-39; and 373-376).

Library Methods

The present disclosure provides methods for making libraries comprising humanized antibodies comprising heavy chain variable regions comprising: (a) an amino acid sequence selected from the group consisting of: (i) SEQ ID NO: 734 or SEQ ID NO: 735, (ii) SEQ ID NO: 736 or SEQ ID NO: 737, (iii) SEQ ID NO: 738 or SEQ ID NO: 739, (iv) SEQ ID NO: 740 or SEQ ID NO: 741, (v) SEQ ID NO: 742 or SEQ ID NO: 743, (vi) SEQ ID NO: 744 or SEQ ID NO: 745, (vii) SEQ ID NO: 746 or SEQ ID NO 747, and (viii) SEQ ID NO: 748 or SEQ ID NO:749; and (b) an ultralong CDR3 sequence. Methods for making libraries of spatially addressed libraries are described in WO 2010/054007. Methods of making libraries in yeast, phage, *E. coli*, or mammalian cells are well known in the art.

The present disclosure also provides methods of screening libraries of humanized antibodies comprising ultralong CDR3 sequences.

Definitions

Figure 2B:
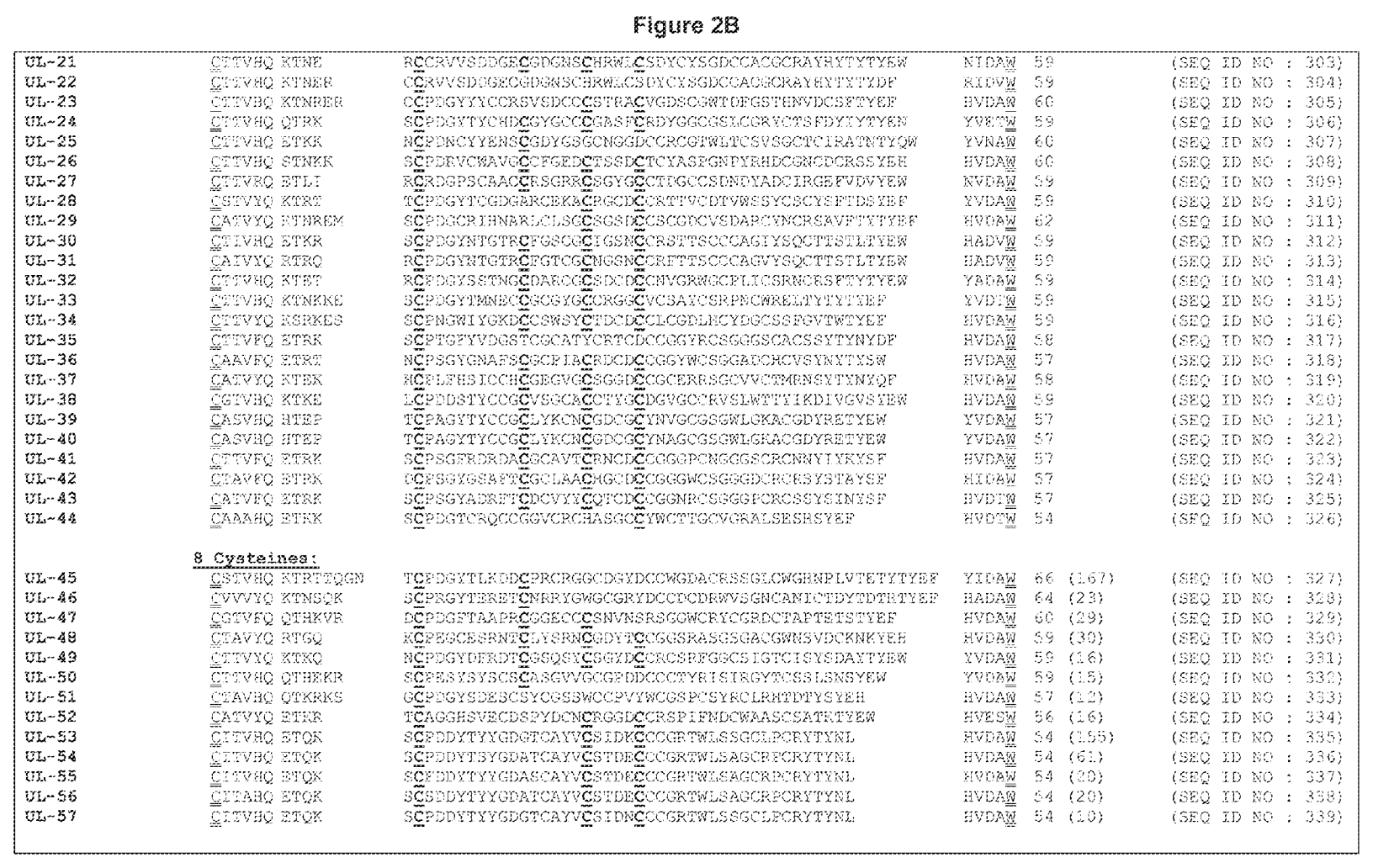

An "ultralong CDR3" or an "ultralong CDR3 sequence", used interchangeably herein, comprises a CDR3 or CDR3 sequence that is not derived from a human antibody sequence. An ultralong CDR3 may be 35 amino acids in length or longer, for example, 40 amino acids in length or longer, 45 amino acids in length or longer, 50 amino acids in length or longer, 55 amino acids in length or longer, or 60 amino acids in length or longer. The length of the ultralong CDR3 may include a non-antibody sequence. An ultralong CDR3 may comprise a non-antibody sequence, including, for example, an interleukin sequence, a hormone sequence, a cytokine sequence, a toxin sequence, a lymphokine sequence, a growth factor sequence, a chemokine sequence, a toxin sequence, or combinations thereof. Preferably, the ultralong CDR3 is a heavy chain CDR3 (CDR-H3 or CDRH3). Preferably, the ultralong CDR3 is a sequence derived from or based on a ruminant (e.g., bovine) sequence. Preferably, the ultralong CDR3 comprises an amino acid sequence of SEQ ID NO: 498, SEQ ID NO: 499 or both. Alternatively or additionally, the ultralong CDR3 comprises an amino acid sequence of: (i) any one of GSKHRLRDY-FLYNE (SEQ ID NO: 501), GSKHRLRDYFLYN (SEQ ID NO: 502), GSKHRLRDYFLY (SEQ ID NO: 503), GSKHRLRDYFL (SEQ ID NO: 504), GSKHRLRDYF (SEQ ID NO: 505), GSKHRLRDY (SEQ ID NO: 506), or GSKHRLRD (SEQ ID NO: 507); (ii) any one of EAGGP-DYRNGYNY (SEQ ID NO: 508), EAGGPDYRNGYN (SEQ ID NO: 509), EAGGPDYRNGY (SEQ ID NO: 510), EAGGPDYRNG (SEQ ID NO: 511), EAGGPDYRN (SEQ ID NO: 512), EAGGPDYR (SEQ ID NO: 513), EAGGPDY (SEQ ID NO: 514), or EAGGPD (SEQ ID NO: 515); (iii) any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523); (iv) any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529); or (v) any one of DKGDSDYDYNL (SEQ ID NO: 530), DKGDSDYDYN (SEQ ID NO: 531), DKGDSDYDY (SEQ ID NO: 532), DKGDSDYD (SEQ ID NO: 533), DKGDSDY (SEQ ID NO: 534), DKGDSD (SEQ ID NO: 535). Alternatively or additionally, the ultralong CDR3 comprises an amino acid sequence of: (i) any one of YGP-NYEEWGDYLATLDV (SEQ ID NO: 536), GPNYEE-WGDYLATLDV (SEQ ID NO: 537), PNYEEWGDY-LATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541); (ii) any one of YDFYDGYYNYHYMDV (SEQ ID NO: 542), DFY-DGYYNYHYMDV (SEQ ID NO: 543), FYDGYYNY-HYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548); (iii) any one of YDFNDGYYNY-HYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNY-HYMDV (SEQ ID NO: 553), or GYYNYHYMDV (SEQ ID NO: 554); (iv) any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTF-WYFDV (SEQ ID NO: 558), YQGSGTFWYFDV (SEQ ID NO: 559), QGSGTFWYFDV (SEQ ID NO: 560), GSGTF-WYFDV (SEQ ID NO: 561), SGTFWYFDV (SEQ ID NO: 562), or GTFWYFDV (SEQ ID NO: 563); or (v) any one of YNLGYSYFYYMDG (SEQ ID NO: 564), NLGYSY-FYYMDG (SEQ ID NO: 565), LGYSYFYYMDG (SEQ ID NO: 566), GYSYFYYMDG (SEQ ID NO: 567), YSY-FYYMDG (SEQ ID NO: 568), or SYFYYMDG (SEQ ID NO: 569). Alternatively or additionally, the ultralong CDR3 comprises an amino acid sequence of: (i) any one of GSKHRLRDYFLYNE (SEQ ID NO: 501), GSKHRLRDY-FLYN (SEQ ID NO: 502), GSKHRLRDYFLY (SEQ ID NO: 503), GSKHRLRDYFL (SEQ ID NO: 504), GSKHRL-RDYF (SEQ ID NO: 505), GSKHRLRDY (SEQ ID NO: 506), or GSKHRLRD (SEQ ID NO: 507), and any one of YGPNYEEWGDYLATLDV (SEQ ID NO: 536), GPNY-EEWGDYLATLDV (SEQ ID NO: 537), PNYEEWGDY-LATLDV (SEQ ID NO: 538), NYEEWGDYLATLDV (SEQ ID NO: 539), YEEWGDYLATLDV (SEQ ID NO: 540), or EEWGDYLATLDV (SEQ ID NO: 541); (ii) any one of EAGGPDYRNGYNY (SEQ ID NO: 508), EAGG-PDYRNGYN (SEQ ID NO: 509), EAGGPDYRNGY (SEQ ID NO: 510), EAGGPDYRNG (SEQ ID NO: 511), EAGG-PDYRN (SEQ ID NO: 512), EAGGPDYR (SEQ ID NO: 513), EAGGPDY (SEQ ID NO: 514), or EAGGPD (SEQ ID NO: 515), and any one of YDFYDGYYNYHYMDV (SEQ ID NO: 542), DFYDGYYNYHYMDV (SEQ ID NO: 543), FYDGYYNYHYMDV (SEQ ID NO: 544), YDGYYNYHYMDV (SEQ ID NO: 545), DGYYNYHYMDV (SEQ ID NO: 546), GYYNYHYMDV (SEQ ID NO: 547), or YYNYHYMDV (SEQ ID NO: 548); (iii) any one of EAGGPIWHDDVKY (SEQ ID NO: 516), EAGGPIWHDDVK (SEQ ID NO: 517), EAGGPIWHDDV (SEQ ID NO: 518), EAGGPIWHDD (SEQ ID NO: 519), EAGGPIWHD (SEQ ID NO: 520), EAGGPIWH (SEQ ID NO: 521), EAGGPIW (SEQ ID NO: 522), or EAGGPI (SEQ ID NO: 523), and any one of YDFNDGYYNYHYMDV (SEQ ID NO: 549), DFYDGYYNYHYMDV (SEQ ID NO: 550), FYDGYYNYHYMDV (SEQ ID NO: 551), YDGYYNYHYMDV (SEQ ID NO: 552), DGYYNYHYMDV (SEQ ID NO: 553), or GYYNYHYMDV (SEQ ID NO: 554); (iv) any one of GTDYTIDDQGI (SEQ ID NO: 524), GTDYTIDDQG (SEQ ID NO: 525), GTDYTIDDQ (SEQ ID NO: 526), GTDYTIDD (SEQ ID NO: 527), GTDYTID (SEQ ID NO: 528), or GTDYTI (SEQ ID NO: 529), and any one of QGIRYQGSGTFWYFDV (SEQ ID NO: 555), GIRYQGSGTFWYFDV (SEQ ID NO: 556), IRYQGSGTFWYFDV (SEQ ID NO: 557), RYQGSGTFWYFDV (SEQ ID NO: 558), YQGSGTFWYFDV (SEQ ID NO: 559), QGSGTFWYFDV (SEQ ID NO: 560), GSGTFWYFDV (SEQ ID NO: 561), SGTFWYFDV (SEQ ID NO: 562), or GTFWYFDV (SEQ ID NO: 563); or (v) any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569), and any one of YNLGYSYFYYMDG (SEQ ID NO: 564), NLGYSYFYYMDG (SEQ ID NO: 565), LGYSYFYYMDG (SEQ ID NO: 566), GYSYFYYMDG (SEQ ID NO: 567), YSYFYYMDG (SEQ ID NO: 568), or SYFYYMDG (SEQ ID NO: 569). An ultralong CDR3 may comprise at least 3 or more cysteine residues, for example, 4 or more cysteine residues, 6 or more cysteine residues, 8 or more cysteine residues, 10 or more cysteine residues, or 12 or more cysteine residues (e.g., 3, 4, 5, 6, 7, 8, 9, 10, 11, 12 or more). An ultralong CDR3 may comprise one or more of the following motifs: a cysteine motif, a $X^1X^2X^3X^4X^5$ motif, a $CX^1X^2X^3X^4X^5$ motif, or a $(X^aX^b)_z$ motif. A "cysteine motif" is a segment of amino acid residues in an ultralong CDR3 that comprises 3 or more cysteine residues including, 4 or more cysteine residues, 5 or more cysteine residues, 6 or more cysteine residues, 7 or more cysteine residues, 8 or more cysteine residues, 9 or more cysteine residues, 10 or more cysteine residues, 11 or more cysteine residues, or 12 or more cysteine residues. A cysteine motif may comprise an amino acid sequence selected from the group consisting of: $CX_{10}CX_5CX_5CXCX_7C$ (SEQ ID NO: 41), $CX_{10}CX_6CX_5CXCX_{15}C$ (SEQ ID NO: 42), $CX_{11}CXCX_5C$ (SEQ ID NO: 43), $CX_{11}CX_5CX_5CXCX_7C$ (SEQ ID NO: 44), $CX_{10}CX_6CX_5CXCX_{13}C$ (SEQ ID NO: 45), $CX_{10}CX_5CXCX_4CX_8C$ (SEQ ID NO: 46), $CX_{10}CX_6CX_6CXCX_7C$ (SEQ ID NO: 47), $CX_{10}CX_4CX_7CXCX_8C$ (SEQ ID NO: 48), $CX_{10}CX_4CX_7CXCX_7C$ (SEQ ID NO: 49), $CX_{13}CX_8CX_8C$ (SEQ ID NO: 50), $CX_{10}CX_6CX_5CXCX_7C$ (SEQ ID NO: 51), $CX_{10}CX_5CX_5C$ (SEQ ID NO: 52), $CX_{10}CX_5CX_6CXCX_7C$ (SEQ ID NO: 53), $CX_{10}CX_6CX_5CX_7CX_9C$ (SEQ ID NO: 54), $CX_9CX_7CX_5CXCX_7C$ (SEQ ID NO: 55), $CX_{10}CX_6CX_5CXCX_9C$ (SEQ ID NO: 56), $CX_{10}CXCX_4CX_5CX_{11}C$ (SEQ ID NO: 57), $CX_7CX_3CX_6CX_5CXCX_5CX_{10}C$ (SEQ ID NO: 58), $CX_{10}CXCX_4CX_5CXCX_2CX_3C$ (SEQ ID NO: 59), $CX_{16}CX_5CXC$ (SEQ ID NO: 60), $CX_6CX_4CXCX_4CX_5C$ (SEQ ID NO: 61), $CX_{11}CX_4CX_5CX_6CX_3C$ (SEQ ID NO: 62), $CX_8CX_2CX_6CX_5C$ (SEQ ID NO: 63), $CX_{10}CX_5CX_5CXCX_{10}C$ (SEQ ID NO: 64), $CX_{10}CXCX_6CX_4CXC$ (SEQ ID NO: 65), $CX_{10}CX_5CX_5CXCX_2C$ (SEQ ID NO: 66), $CX_{14}CX_2CX_3CXCXC$ (SEQ ID NO: 67), $CX_{15}CX_5CXC$ (SEQ ID NO: 68), $CX_4CX_6CX_9CX_2CX_{11}C$ (SEQ ID NO: 69), $CX_6CX_4CX_5CX_5CX_{12}C$ (SEQ ID NO: 70), $CX_7CX_3CXCXCX_4CX_5CX_9C$ (SEQ ID NO: 71), $CX_{10}CX_6CX_5C$ (SEQ ID NO: 72), $CX_7CX_3CX_5CX_5CX_9C$ (SEQ ID NO: 73), $CX_7CX_5CXCX_2C$ (SEQ ID NO: 74), $CX_{10}CXCX_6C$ (SEQ ID NO: 75), $CX_{10}CX_3CX_3CX_5CX_7CXCX_6C$ (SEQ ID NO: 76), $CX_{10}CX_4CX_5CX_{12}CX_2C$ (SEQ ID NO: 77), $CX_{12}CX_4CX_5CXCXCX_9CX_3C$ (SEQ ID NO: 78), $CX_{12}CX_4CX_5CX_{12}CX_2C$ (SEQ ID NO: 79), $CX_{10}CX_6CX_5CXCX_{11}C$ (SEQ ID NO: 80), $CX_{16}CX_5CXCXCX_{14}C$ (SEQ ID NO: 81), $CX_{10}CX_5CXCX_8CX_6C$ (SEQ ID NO: 82), $CX_{12}CX_4CX_5CX_8CX_2C$ (SEQ ID NO: 83), $CX_{12}CX_5CX_5CXCX_8C$ (SEQ ID NO: 84), $CX_{10}CX_6CX_5CXCX_4CXCX_9C$ (SEQ ID NO: 85), $CX_{11}CX_4CX_5CX_8CX_2C$ (SEQ ID NO: 86), $CX_{10}CX_6CX_5CX_8CX_2C$ (SEQ ID NO: 87), $CX_{10}CX_6CX_5CXCX_8C$ (SEQ ID NO: 88), $CX_{10}CX_6CX_5CXCX_3CX_8CX_2C$ (SEQ ID NO: 89), $CX_{10}CX_6CX_5CX_3CX_8C$ (SEQ ID NO: 90), $CX_{10}CX_6CX_5CXCX_2CX_6CX_5C$ (SEQ ID NO: 91), $CX_7CX_6CX_3CX_3CX_9C$ (SEQ ID NO: 92), $CX_9CX_8CX_5CX_6CX_5C$ (SEQ ID NO: 93), $CX_{10}CX_2CX_2CX_7CXCX_{11}CX_5C$ (SEQ ID NO: 94), and $CX_{10}CX_6CX_5CXCX_2CX_8CX_4C$ (SEQ ID NO: 95). Alternatively, a cysteine motif may comprise an amino acid sequence selected from the group consisting of: $CCX_3CXCX_3CX_2CCXCX_5CX_9CX_5CXC$ (SEQ ID NO: 96), $CX_6CX_2CX_5CX_4CCXCX_4CX_6CXC$ (SEQ ID NO: 97), $CX_7CXCX_5CX_4CCCX_4CX_6CXC$ (SEQ ID NO: 98), $CX_9CX_3CXCX_2CXCCCX_6CX_4C$ (SEQ ID NO: 99), $CX_5CX_3CXCX_4CX_4CCX_{10}CX_2CC$ (SEQ ID NO: 100), $CX_5CXCX_1CXCX_3CCX_3CX_4CX_{10}C$ (SEQ ID NO: 101), $CX_9CCCX_3CX_4CCCX_5CX_6C$ (SEQ ID NO: 102), $CCX_8CX_5CX_4CX_3CX_4CCXCX_1C$ (SEQ ID NO: 103), $CCX_6CCX_5CCX_4CX_4CX_{12}C$ (SEQ ID NO: 104), $CX_6CX_2CX_3CCCX_4CX_5CX_3CX_3C$ (SEQ ID NO: 105), $CX_3CX_5CX_6CX_4CCXCX_5CX_4CXC$ (SEQ ID NO: 106), $CX_4CX_4CCX_4CX_4CXCX_{11}CX_2CXC$ (SEQ ID NO: 107), $CX_5CX_2CCX_5CX_4CCX_3CCX_7C$ (SEQ ID NO: 108), $CX_5CX_5CX_3CX_2CXCCX_4CX_7CXC$ (SEQ ID NO: 109), $CX_3CX_7CX_3CX_4CCXCX_2CX_5CX_2C$ (SEQ ID NO: 110), $CX_9CX_3CXCX_4CCX_5CCCX_6C$ (SEQ ID NO: 111), $CX_9CX_3CXCX_2CXCCX_6CX_5CX_3C$ (SEQ ID NO: 112), $CX_8CXCX_3CCX_3CXCX_3CX_4C$ (SEQ ID NO: 113), $CX_5CCX_4CX_2CXCCXCX_4CX_3C$ (SEQ ID NO: 114), $CX_{10}CXCX_3CX_2CXCCX_4CX_5CXC$ (SEQ ID NO: 115), $CX_9CXCX_3CX_2CXCCX_4CX_5CXC$ (SEQ ID NO: 116), $CX_6CCXCX_5CX_4CCXCX_5CX_2C$ (SEQ ID NO: 117), $CX_6CCXCX_3CXCCX_3CX_4CC$ (SEQ ID NO: 118), $CX_6CCXCX_3CXCX_2CXCX_4CX_8C$ (SEQ ID NO: 119), $CX_4CX_2CCX_3CXCX_4CCX_2CX_3C$ (SEQ ID NO: 120), $CX_3CX_5CX_3CCCX_4CX_9C$ (SEQ ID NO: 121), $CCX_9CX_3CXCCX_3CX_5C$ (SEQ ID NO: 122), $CX_5CX_2CX_3CX_4CCX_4CX_5C$ (SEQ ID NO: 123), $CX_5CX_7CX_4CCXCX_7CX_3C$ (SEQ ID NO: 124), $CX_9CX_3CCCX_{10}CX_2CX_3C$ (SEQ ID NO: 125), $CX_3CX_5CX_5CX_4CCX_{10}CX_6C$ (SEQ ID NO: 126), $CX_9CX_5CX_4CCXCX_5CX_4C$ (SEQ ID NO: 127), $CX_7CXCX_6CX_4CCCX_{10}C$ (SEQ ID NO: 128), $CX_8CX_2CX_4CCX_4CX_3CX_3C$ (SEQ ID NO: 129), $CX_7CX_5CXCX_4CCX_7CX_4C$ (SEQ ID NO: 130), $CX_{11}CX_3CX_4CCCX_8CX_2C$ (SEQ ID NO: 131), $CX_2CX_3CX_4CCX_4CX_5CX_{15}C$ (SEQ ID NO: 132), $CX_9CX_5CX_4CCX_7C$ (SEQ ID NO: 133), $CX_9CX_7CX_3CX_2CX_6C$ (SEQ ID NO: 134), $CX_9CX_5CX_4CCX_{14}C$ (SEQ ID NO: 135), $CX_9CX_5CX_4CCX_8C$ (SEQ ID NO: 136), $CX_9CX_6CX_4CCXC$ (SEQ ID NO: 137), $CX_5CCX_7CX_4CX_{12}$ (SEQ ID NO: 138), $CX_{10}CX_3CX_4CCX_4C$ (SEQ ID NO: 139), $CX_9CX_4CCX_5CX_4C$ (SEQ ID NO: 140), $CX_{10}CX_3CX_4CX_7CXC$ (SEQ ID NO: 141), $CX_7CX_7CX_2CX_2CX_3C$ (SEQ ID NO: 142), $CX_9CX_4CX_4CCX_6C$ (SEQ ID NO: 143), $CX_7CXCX_3CXCX_6C$ (SEQ ID NO: 144), $CX_7CXCX_4CXCX_4C$ (SEQ ID NO: 145), $CX_9CX_5CX_4C$ (SEQ ID NO: 146), $CX_3CX_6CX_8C$ (SEQ ID NO: 147), $CX_{10}CXCX_4C$ (SEQ ID NO: 148), $CX_{10}CCX_4C$ (SEQ ID NO: 149), $CX_{15}C$ (SEQ ID NO: 150), $CX_{10}C$ (SEQ ID NO: 151), and $CX_9C$ (SEQ ID NO: 152). A cysteine motif is preferably positioned within an ultralong CDR3 between a $X^1X^2X^3X^4X^5$ motif and a $(X^aX^b)_z$ motif. A "$X^1X^2X^3X^4X^5$ motif" is a series of five consecutive amino acid residues in an ultralong CDR3, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q). In some embodiments, the $X^1X^2X^3X^4X^5$ motif may be TTVHQ (SEQ ID NO: 153), TSVHQ (SEQ ID NO: 154), SSVTQ (SEQ ID NO: 155), STVHQ (SEQ ID NO: 156), ATVRQ (SEQ ID NO: 157), TTVYQ (SEQ ID NO: 158), SPVHQ (SEQ ID NO: 159), ATVYQ (SEQ ID NO: 160), TAVYQ (SEQ ID NO: 161), TNVHQ (SEQ ID NO: 162), ATVHQ (SEQ ID NO: 163), STVYQ (SEQ ID NO: 164), TIVHQ (SEQ ID NO: 165), AIVYQ (SEQ ID NO: 166), TTVFQ (SEQ ID NO: 167), AAVFQ (SEQ ID NO: 168), GTVHQ (SEQ ID NO: 169), ASVHQ (SEQ ID NO: 170), TAVFQ (SEQ ID NO: 171), ATVFQ (SEQ ID NO: 172), AAAHQ (SEQ ID NO: 173), VVVYQ (SEQ ID NO: 174), GTVFQ (SEQ ID NO: 175), TAVHQ (SEQ ID NO: 176), ITVHQ (SEQ ID NO: 177), ITAHQ (SEQ ID NO: 178), VTVHQ (SEQ ID NO: 179); AAVHQ (SEQ ID NO: 180), GTVYQ (SEQ ID NO: 181), TTVLQ (SEQ ID NO: 182), TTTHQ (SEQ ID NO: 183), or TTDYQ (SEQ ID NO: 184). A "$CX^1X^2X^3X^4X^5$ motif" is a series of six consecutive amino acid residues in an ultralong CDR3, wherein the first amino acid residue is cysteine, wherein $X^1$ is threonine (T), glycine (G), alanine (A), serine (S), or valine (V), wherein $X^2$ is serine (S), threonine (T), proline (P), isoleucine (I), alanine (A), valine (V), or asparagine (N), wherein $X^3$ is valine (V), alanine (A), threonine (T), or aspartic acid (D), wherein $X^4$ is histidine (H), threonine (T), arginine (R), tyrosine (Y), phenylalanine (F), or leucine (L), and wherein $X^5$ is glutamine (Q). In some embodiments, the $CX^1X^2X^3X^4X^5$ motif is CTTVHQ (SEQ ID NO: 185), CTSVHQ (SEQ ID NO: 186), CSSVTQ (SEQ ID NO: 187), CSTVHQ (SEQ ID NO: 188), CATVRQ (SEQ ID NO: 189), CTTVYQ (SEQ ID NO: 190), CSPVHQ (SEQ ID NO: 191), CATVYQ (SEQ ID NO: 192), CTAVYQ (SEQ ID NO: 193), CTNVHQ (SEQ ID NO: 194), CATVHQ (SEQ ID NO: 195), CSTVYQ (SEQ ID NO: 196), CTIVHQ (SEQ ID NO: 197), CAIVYQ (SEQ ID NO: 198), CTTVFQ (SEQ ID NO: 199), CAAVFQ (SEQ ID NO: 200), CGTVHQ (SEQ ID NO: 201), CASVHQ (SEQ ID NO: 202), CTAVFQ (SEQ ID NO: 203), CATVFQ (SEQ ID NO: 204), CAAAHQ (SEQ ID NO: 205), CVVVYQ (SEQ ID NO: 206), CGTVFQ (SEQ ID NO: 207), CTAVHQ (SEQ ID NO: 208), CITVHQ (SEQ ID NO: 209), CITAHQ (SEQ ID NO: 210), CVTVHQ (SEQ ID NO: 211); CAAVHQ (SEQ ID NO: 212), CGTVYQ (SEQ ID NO: 213), CTTVLQ (SEQ ID NO: 214), CTTTHQ (SEQ ID NO: 215), or CTTDYQ (SEQ ID NO: 216). A "$(X^aX^b)_z$" motif is a repeating series of two amino acid residues in an ultralong CDR3, wherein $X^a$ is any amino acid residue, $X^b$ is an aromatic amino acid selected from the group consisting of: tyrosine (Y), phenylalanine (F), tryptophan (W), and histidine (H), and wherein z is 1-4. In some embodiments, the $(X^aX^b)_z$ motif may comprise CYTYNYEF (SEQ ID NO: 217), HYTYTYDF (SEQ ID NO: 218), HYTYTYEW (SEQ ID NO: 219), KHRYTYEW (SEQ ID NO: 220), NYIYKYSF (SEQ ID NO: 221), PYIYTYQF (SEQ ID NO: 222), SFTYTYEW (SEQ ID NO: 223), SYIYIYQW (SEQ ID NO: 224), SYNYTYSW (SEQ ID NO: 225), SYSYSYEY (SEQ ID NO: 226), SYTYNYDF (SEQ ID NO: 227), SYTYNYEW (SEQ ID NO: 228), SYTYNYQF (SEQ ID NO: 229), SYVWTHNF (SEQ ID NO: 230), TYKYVYEW (SEQ ID NO: 231), TYTYTYEF (SEQ ID NO: 232), TYTYTYEW (SEQ ID NO: 233), VFTYTYEF (SEQ ID NO: 234), AYTYEW (SEQ ID NO: 235), DYIYTY (SEQ ID NO: 236), IHSYEF (SEQ ID NO: 237), SFTYEF (SEQ ID NO: 238), SHSYEF (SEQ ID NO: 239), THTYEF (SEQ ID NO: 240), TWTYEF (SEQ ID NO: 241), TYNYEW (SEQ ID NO: 242), TYSYEF (SEQ ID NO: 243), TYSYEH (SEQ ID NO: 244), TYTYDF (SEQ ID NO: 245), TYTYEF (SEQ ID NO: 246), TYTYEW (SEQ ID NO: 247), AYEF (SEQ ID NO: 248), AYSF (SEQ ID NO: 249), AYSY (SEQ ID NO: 250), CYSF (SEQ ID NO: 251), DYTY (SEQ ID NO: 252), KYEH (SEQ ID NO: 253), KYEW (SEQ ID NO: 254), MYEF (SEQ ID NO: 255), NWIY (SEQ ID NO: 256), NYDY (SEQ ID NO: 257), NYQW (SEQ ID NO: 258), NYSF (SEQ ID NO: 259), PYEW (SEQ ID NO: 260), RYNW (SEQ ID NO: 261), RYTY (SEQ ID NO: 262), SYEF (SEQ ID NO: 263), SYEH (SEQ ID NO: 264), SYEW (SEQ ID NO: 265), SYKW (SEQ ID NO: 266), SYTY (SEQ ID NO: 267), TYDF (SEQ ID NO: 268), TYEF (SEQ ID NO: 269), TYEW (SEQ ID NO: 270), TYQW (SEQ ID NO: 271), TYTY (SEQ ID NO: 272), or VYEW (SEQ ID NO: 273). In some embodiments, the $(X^aX^b)_z$ motif is YXYXYX. An ultralong CDR3 may comprise an amino acid sequence that is derived from or based on SEQ ID NO: 40 (see, e.g., amino acid residues 3-6 of SEQ ID NO: 1-4; see also, e.g., VH germline sequences in FIGS. 2A-C). A variable region that comprises an ultralong CDR3 may include an amino acid sequence that is SEQ ID NO: 1 (CTTVHQ), SEQ ID NO:2 (CTSVHQ), SEQ ID NO:3 (CSSVTQ) or SEQ ID NO: 4 (CTTVHP). Such a sequence may be derived from or based on a bovine germline VH gene sequence (e.g., SEQ ID NO: 1). An ultralong CDR3 may comprise a sequence derived from or based on a non-human DH gene sequence, for example, SEQ ID NO: 5 (see also, e.g., Koti, et al. (2010) *Mol. Immunol.* 47: 2119-2128), or alternative sequences such as SEQ ID NO: 6, 7, 8, 9, 10, 11 or 12 (see also, e.g., DH2 germline sequences in FIGS. 2A-C). An ultralong CDR3 may comprise a sequence derived from or based on a JH sequence, for example, SEQ ID NO: 13 (see also, e.g., Hosseini, et al. (2004) *Int. Immunol.* 16: 843-852), or alternative sequences such as SEQ ID NO: 14, 15, 16 or 17 (see also, e.g., JH1 germline sequences in FIGS. 2A-C). In an embodiment, an ultralong CDR3 may comprise a sequence derived from or based on a non-human VH sequence (e.g., SEQ ID NO: 1, 2, 3 or 4; alternatively VH sequences in FIGS. 2A-C) and/or a sequence derived from or based on a non-human DH sequence (e.g., SEQ ID NO: 5, 6, 7, 8, 9, 10, 11 or 12; alternatively DH sequences in FIGS. 2A-C) and/or a sequence derived from or based on a JH sequence (e.g., SEQ ID NO: 13, 14, 15, 16, or 17; alternatively JH sequences in FIGS. 2A-C), and optionally an additional sequence comprising two to six amino acids or more (e.g., IR, IF, SEQ ID NO: 18, 19, 20 or 21) such as, for example, between the VH derived sequence and the DH derived sequence. In another embodiment, an ultralong CDR3 may comprise a sequence derived from or based on SEQ ID NO: 22, 23, 24, 25, 26, 27, or 28 (see also, e.g., SEQ ID NOs: 276-359 in FIGS. 2A-C).

An "isolated" biological molecule, such as the various polypeptides, polynucleotides, and antibodies disclosed herein, refers to a biological molecule that has been identified and separated and/or recovered from at least one component of its natural environment.

"Antagonist" refers to any molecule that partially or fully blocks, inhibits, or neutralizes an activity (e.g., biological activity) of a polypeptide. Also encompassed by "antagonist" are molecules that fully or partially inhibit the transcription or translation of mRNA encoding the polypeptide. Suitable antagonist molecules include, e.g., antagonist antibodies or antibody fragments; fragments or amino acid sequence variants of a native polypeptide; peptides; antisense oligonucleotides; small organic molecules; and nucleic acids that encode polypeptide antagonists or antagonist antibodies. Reference to "an" antagonist encompasses a single antagonist or a combination of two or more different antagonists.

"Agonist" refers to any molecule that partially or fully mimics a biological activity of a polypeptide. Also encompassed by "agonist" are molecules that stimulate the transcription or translation of mRNA encoding the polypeptide. Suitable agonist molecules include, e.g., agonist antibodies or antibody fragments; a native polypeptide; fragments or amino acid sequence variants of a native polypeptide; peptides; antisense oligonucleotides; small organic molecules; and nucleic acids that encode polypeptides agonists or antibodies. Reference to "an" agonist encompasses a single agonist or a combination of two or more different agonists.

An "isolated" antibody refers to one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody (e.g., as determined by the Lowry method), and preferably to more than 99% by weight, (2) to a degree sufficient to obtain at least 15 residues of N-terminal or internal amino acid sequence (e.g., by use of a spinning cup sequenator), or (3) to homogeneity by SDS-PAGE under reducing or nonreducing conditions (e.g., using Coomassie™ blue or, preferably, silver stain). Isolated antibody includes the antibody in situ within recombinant cells since at least one component of the antibody's natural environment will not be present. Similarly, isolated antibody includes the antibody in medium around recombinant cells. An isolated antibody may be prepared by at least one purification step.

An "isolated" nucleic acid molecule refers to a nucleic acid molecule that is identified and separated from at least one contaminant nucleic acid molecule with which it is ordinarily associated in the natural source of the antibody nucleic acid. An isolated nucleic acid molecule is other than in the form or setting in which it is found in nature. Isolated nucleic acid molecules therefore are distinguished from the nucleic acid molecule as it exists in natural cells.

However, an isolated nucleic acid molecule includes a nucleic acid molecule contained in cells that express an antibody where, for example, the nucleic acid molecule is in a chromosomal location different from that of natural cells.

Variable domain residue numbering as in Kabat or amino acid position numbering as in Kabat, and variations thereof, refers to the numbering system used for heavy chain variable domains or light chain variable domains of the compilation of antibodies in Kabat et al., Sequences of Proteins of Immunological Interest, 5th Ed. Public Health Service, National Institutes of Health, Bethesda, Md. (1991). Using this numbering system, the actual linear amino acid sequence may contain fewer or additional amino acids corresponding to a shortening of, or insertion into, a FR or CDR of the variable domain. For example, a heavy chain variable domain may include a single amino acid insert (e.g., residue 52a according to Kabat) after residue 52 of H2 and inserted residues (e.g., residues 82a, 82b, and 82c, etc according to Kabat) after heavy chain FR residue 82. The Kabat numbering of residues may be determined for a given antibody by alignment at regions of homology of the sequence of the antibody with a "standard" Kabat numbered sequence.

"Substantially similar," or "substantially the same", refers to a sufficiently high degree of similarity between two numeric values (generally one associated with an antibody disclosed herein and the other associated with a reference/comparator antibody) such that one of skill in the art would consider the difference between the two values to be of little or no biological and/or statistical significance within the context of the biological characteristic measured by said values (e.g., Kd values). The difference between said two values is preferably less than about 50%, preferably less than about 40%, preferably less than about 30%, preferably less than about 20%, preferably less than about 10% as a function of the value for the reference/comparator antibody.

"Binding affinity" generally refers to the strength of the sum total of noncovalent interactions between a single binding site of a molecule (e.g., an antibody) and its binding partner (e.g., an antigen). Unless indicated otherwise, "binding affinity" refers to intrinsic binding affinity which reflects a 1:1 interaction between members of a binding pair (e.g., antibody and antigen). The affinity of a molecule X for its partner Y can generally be represented by the dissociation constant. Affinity can be measured by common methods known in the art, including those described herein. Low-affinity antibodies generally bind antigen slowly and tend to dissociate readily, whereas high-affinity antibodies generally bind antigen faster and tend to remain bound longer. A variety of methods of measuring binding affinity are known in the art, any of which can be used for purposes of the present disclosure.

An "on-rate" or "rate of association" or "association rate" or "$k_{on}$" can be determined with a surface plasmon resonance technique such as Biacore (e.g., Biacore A100, Biacore™-2000, Biacore™-3000, Biacore, Inc., Piscataway, N.J.) carboxymethylated dextran biosensor chips (CM5, Biacore Inc.) and according to the supplier's instructions.

"Vector" refers to a nucleic acid molecule capable of transporting another nucleic acid to which it has been linked. One type of vector is a "plasmid", which refers to a circular double stranded DNA loop into which additional DNA segments may be ligated. Another type of vector is a phage vector. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "recombinant vectors"). In general, expression vectors of utility in recombinant DNA techniques are often in the form of plasmids. Accordingly, "plasmid" and "vector" may, at times, be used interchangeably as the plasmid is a commonly used form of vector.

"Gene" refers to a nucleic acid (e.g., DNA) sequence that comprises coding sequences necessary for the production of a polypeptide, precursor, or RNA (e.g., rRNA, tRNA). The polypeptide can be encoded by a full length coding sequence or by any portion of the coding sequence so long as the desired activity or functional properties (e.g., enzymatic activity, ligand binding, signal transduction, immunogenicity, etc.) of the full-length or fragment are retained. The term also encompasses the coding region of a structural gene and the sequences located adjacent to the coding region on both the 5' and 3' ends for a distance of about 1 kb or more on either end such that the gene corresponds to the length of the full-length mRNA.

Sequences located 5' of the coding region and present on the mRNA are referred to as 5' non-translated sequences. Sequences located 3' or downstream of the coding region and present on the mRNA are referred to as 3' non-translated sequences. The term "gene" encompasses both cDNA and genomic forms of a gene. A genomic form or clone of a gene contains the coding region interrupted with non-coding sequences termed "introns" or "intervening regions" or "intervening sequences." Introns are segments of a gene that are transcribed into nuclear RNA (hnRNA); introns can contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide. In addition to containing introns, genomic forms of a gene can also include sequences located on both the 5' and 3' end of the sequences that are present on the RNA transcript. These sequences are referred to as "flanking" sequences or regions (these flanking sequences are located 5' or 3' to the non-translated sequences present on the mRNA transcript). The 5' flanking region can contain regulatory sequences such as promoters and enhancers that control or influence the transcription of the gene. The 3' flanking region can contain sequences that direct the termination of transcription, post transcriptional cleavage and polyadenylation.

"Polynucleotide," or "nucleic acid," as used interchangeably herein, refers to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase, or by a synthetic reaction. A polynucleotide may comprise modified nucleotides, such as methylated nucleotides and their analogs. If present, modification to the nucleotide structure may be imparted before or after assembly of the polymer. The sequence of nucleotides may be interrupted by non-nucleotide components. A polynucleotide may be further modified after synthesis, such as by conjugation with a label. Other types of modifications include, for example, "caps", substitution of one or more of the naturally occurring nucleotides with an analog, internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.), those containing pendant moieties, such as, for example, proteins (e.g., nucleases, toxins, antibodies, signal peptides, poly-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid or semi-solid supports. The 5' and 3' terminal OH can be phosphorylated or substituted with amines or organic capping group moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, alpha-anomeric sugars, epimeric sugars such as arabinose, xyloses or lyxoses, pyranose sugars, furanose sugars, sedoheptuloses, acyclic analogs and a basic nucleoside analogs such as methyl riboside. One or more phosphodiester linkages may be replaced by alternative linking groups. These alternative linking groups include, but are not limited to, embodiments wherein phosphate is replaced by P(O)S ("thioate"), P(S)S ("dithioate"), "(O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

"Oligonucleotide" refers to short, generally single stranded, generally synthetic polynucleotides that are generally, but not necessarily, less than about 200 nucleotides in length. The terms "oligonucleotide" and "polynucleotide" are not mutually exclusive. The description above for polynucleotides is equally and fully applicable to oligonucleotides.

"Stringent hybridization conditions" refer to conditions under which a probe will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in Tijssen, Techniques in Biochemistry and Molecular Biology—Hybridization with Nucleic Probes, "Overview of principles of hybridization and the strategy of nucleic acid assays" (1993). Generally, stringent conditions are selected to be about 5-10° C. lower than the thermal melting point (Tm) for the specific sequence at a defined ionic strength pH.

The Tm is the temperature (under defined ionic strength, pH, and nucleic concentration) at which 50% of the probes complementary to the target hybridize to the target sequence at equilibrium (as the target sequences are present in excess, at Tm, 50% of the probes are occupied at equilibrium). Stringent conditions may also be achieved with the addition of destabilizing agents such as formamide. For selective or specific hybridization, a positive signal is at least two times background, preferably 10 times background hybridization. Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C.

"Recombinant" when used with reference to a cell, nucleic acid, protein or vector indicates that the cell, nucleic acid, protein or vector has been modified by the introduction of a heterologous nucleic acid or protein, the alteration of a native nucleic acid or protein, or that the cell is derived from a cell so modified. For example, recombinant cells express genes that are not found within the native (non-recombinant) form of the cell or express native genes that are overexpressed or otherwise abnormally expressed such as, for example, expressed as non-naturally occurring fragments or splice variants. By the term "recombinant nucleic acid" herein is meant nucleic acid, originally formed in vitro, in general, by the manipulation of nucleic acid, e.g., using polymerases and endonucleases, in a form not normally found in nature. In this manner, operably linkage of different sequences is achieved. Thus an isolated nucleic acid, in a linear form, or an expression vector formed in vitro by ligating DNA molecules that are not normally joined, are both considered recombinant for the purposes of this disclosure. It is understood that once a recombinant nucleic acid is made and introduced into a host cell or organism, it will replicate non-recombinantly, e.g., using the in vivo cellular machinery of the host cell rather than in vitro manipulations; however, such nucleic acids, once produced recombinantly, although subsequently replicated non-recombinantly, are still considered recombinant for the purposes disclosed herein. Similarly, a "recombinant protein" is a protein made using recombinant techniques, e.g., through the expression of a recombinant nucleic acid as depicted above.

"Percent (%) amino acid sequence identity" with respect to a peptide or polypeptide sequence refers to the percentage of amino acid residues in a candidate sequence that are identical with the amino acid residues in the specific peptide or polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or MegAlign (DNASTAR) software. Those skilled in the art can determine appropriate parameters for measuring alignment, including any algorithms needed to achieve maximal alignment over the full length of the sequences being compared.

"Polypeptide," "peptide," "protein," and "protein fragment" may be used interchangeably to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymers.

"Amino acid" refers to naturally occurring and synthetic amino acids, as well as amino acid analogs and amino acid mimetics that function similarly to the naturally occurring amino acids. Naturally occurring amino acids are those encoded by the genetic code, as well as those amino acids that are later modified, e.g., hydroxyproline, gamma-carboxyglutamate, and O-phosphoserine. Amino acid analogs refers to compounds that have the same basic chemical structure as a naturally occurring amino acid, e.g., an alpha carbon that is bound to a hydrogen, a carboxyl group, an amino group, and an R group, e.g., homoserine, norleucine, methionine sulfoxide, methionine methyl sulfonium. Such analogs can have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions similarly to a naturally occurring amino acid.

"Conservatively modified variants" applies to both amino acid and nucleic acid sequences. "Amino acid variants" refers to amino acid sequences. With respect to particular nucleic acid sequences, conservatively modified variants refers to those nucleic acids which encode identical or essentially identical amino acid sequences, or where the nucleic acid does not encode an amino acid sequence, to essentially identical or associated (e.g., naturally contiguous) sequences. Because of the degeneracy of the genetic code, a large number of functionally identical nucleic acids encode most proteins. For instance, the codons GCA, GCC, GCG and GCU all encode the amino acid alanine. Thus, at every position where an alanine is specified by a codon, the codon can be altered to another of the corresponding codons described without altering the encoded polypeptide. Such nucleic acid variations are "silent variations," which are one species of conservatively modified variations. Every nucleic acid sequence herein which encodes a polypeptide also describes silent variations of the nucleic acid. One of skill will recognize that in certain contexts each codon in a nucleic acid (except AUG, which is ordinarily the only codon for methionine, and TGG, which is ordinarily the only codon for tryptophan) can be modified to yield a functionally identical molecule. Accordingly, silent variations of a nucleic acid which encodes a polypeptide is implicit in a described sequence with respect to the expression product, but not with respect to actual probe sequences. As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" including where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles disclosed herein. Typically conservative substitutions include: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)).

"Antibodies" (Abs) and "immunoglobulins" (Igs) are glycoproteins having similar structural characteristics.

While antibodies may exhibit binding specificity to a specific antigen, immunoglobulins may include both antibodies and other antibody-like molecules which generally lack antigen specificity. Polypeptides of the latter kind are, for example, produced at low levels by the lymph system and at increased levels by myelomas.

"Antibody" and "immunoglobulin" are used interchangeably in the broadest sense and include monoclonal antibodies (e.g., full length or intact monoclonal antibodies), polyclonal antibodies, multivalent antibodies, multispecific antibodies (e.g., bispecific antibodies so long as they exhibit the desired biological activity) and may also include certain antibody fragments (as described in greater detail herein). An antibody can be human, humanized and/or affinity matured. An antibody may refer to immunoglobulins and immunoglobulin portions, whether natural or partially or wholly synthetic, such as recombinantly produced, including any portion thereof containing at least a portion of the variable region of the immunoglobulin molecule that is sufficient to form an antigen binding site. Hence, an antibody or portion thereof includes any protein having a binding domain that is homologous or substantially homologous to an immunoglobulin antigen binding site. For example, an antibody may refer to an antibody that contains two heavy chains (which can be denoted H and H') and two light chains (which can be denoted L and L'), where each heavy chain can be a full-length immunoglobulin heavy chain or a portion thereof sufficient to form an antigen binding site (e.g. heavy chains include, but are not limited to, VH, chains VH-CH1 chains and VH-CH1-CH2-CH3 chains), and each light chain can be a full-length light chain or a thereof sufficient to form an antigen binding site (e.g. light chains include, but are not limited to, VL chains and VL-CL chains). Each heavy chain (H and H') pairs with one light chain (L and L', respectively). Typically, antibodies minimally include all or at least a portion of the variable heavy (VH) chain and/or the variable light (VL) chain. The antibody also can include all or a portion of the constant region. For example, a full-length antibody is an antibody having two full-length heavy chains (e.g. VH-CH1-CH2-CH3 or VH-CH1-CH2-CH3-CH4) and two full-length light chains (VL-CL) and hinge regions, such as antibodies produced by antibody secreting B cells and antibodies with the same domains that are produced synthetically. Additionally, an "antibody" refers to a protein of the immunoglobulin family or a polypeptide comprising fragments of an immunoglobulin that is capable of noncovalently, reversibly, and in a specific manner binding a corresponding antigen.

An exemplary antibody structural unit comprises a tetramer. Each tetramer is composed of two identical pairs of polypeptide chains, each pair having one "light" (about 25 kD) and one "heavy" chain (about 50-70 kD), connected through a disulfide bond. The recognized immunoglobulin genes include the κ, λ, α, γ, δ, ε, and μ constant region genes, as well as the myriad immunoglobulin variable region genes. Light chains are classified as either κ or λ. Heavy chains are classified as γ, μ, α, δ, or ε, which in turn define the immunoglobulin classes, IgG, IgM, IgA, IgD, and IgE, respectively. The N-terminus of each chain defines a variable region of about 100 to 110 or more amino acids primarily responsible for antigen recognition. The terms variable light chain (VL) and variable heavy chain (VH) refer to these regions of light and heavy chains respectively.

"Variable" refers to the fact that certain portions of the variable domains (also referred to as variable regions) differ extensively in sequence among antibodies and are used in the binding and specificity of each particular antibody for its particular antigen. However, the variability is not evenly distributed throughout the variable domains of antibodies. It is concentrated in three segments called complementarity-determining regions (CDRs) or hypervariable regions (HVRs) both in the light-chain and the heavy-chain variable domains. CDRs include those specified as Kabat, Chothia, and IMGT as shown herein within the variable region sequences. The more highly conserved portions of variable domains are called the framework (FR). The variable domains of native heavy and light chains each comprise four FR regions, largely adopting a β-sheet configuration, connected by three CDRs, which form loops connecting, and in some cases forming part of, the β-sheet structure. The CDRs in each chain are held together in close proximity by the FR regions and, with the CDRs from the other chain, contribute to the formation of the antigen-binding site of antibodies (see Kabat et al., *Sequences of Proteins of Immunological Interest*, Fifth Edition, National Institute of Health, Bethesda, Md. (1991)). The constant domains are not involved directly in binding an antibody to an antigen, but exhibit various effector functions, such as participation of the antibody in antibody-dependent cellular toxicity.

Papain digestion of antibodies produces two identical antigen-binding fragments, called "Fab" fragments, each with a single antigen-binding site, and a residual "Fc" fragment, whose name reflects its ability to crystallize readily. Pepsin treatment yields an F(ab')$_2$ fragment that has two antigen-combining sites and is still capable of cross-linking antigen.

"Fv" refers to an antibody fragment which contains an antigen-recognition and antigen-binding site. In a two-chain Fv species, this region consists of a dimer of one heavy and one light chain variable domain in non-covalent association. In a single chain Fv (scFv) species, one heavy chain and one light chain variable domain can be covalently linked by a flexible peptide linker such that the light and heavy chains can associate in a "dimeric" structure analogous to that in a two-chain Fv (scFv) species. It is in this configuration that the three CDRs of each variable domain interact to define an antigen-binding site on the surface of the VH-VL dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa (κ) and lambda (λ), based on the amino acid sequences of their constant domains.

Depending on the amino acid sequence of the constant domain of their heavy chains, immunoglobulins can be assigned to different classes. There are five major classes of immunoglobulins: IgA, IgD, IgE, IgG, and IgM, and several of these can be further divided into subclasses (isotypes), e.g., IgG$_1$, IgG$_2$, IgG$_3$, IgG$_4$, IgA$_1$, and IgA$_2$. The heavy-chain constant domains that correspond to the different classes of immunoglobulins are called α, δ, ε, γ, and μ, respectively. The subunit structures and three-dimensional configurations of different classes of immunoglobulins are well known.

"Antibody fragments" comprise only a portion of an intact antibody, wherein the portion preferably retains at least one, preferably most or all, of the functions normally associated with that portion when present in an intact antibody. Examples of antibody fragments include Fab, Fab', F(ab')2, single-chain Fvs (scFv), Fv, dsFv, diabody, Fd and Fd' fragments Fab fragments, Fd fragments, scFv fragments, linear antibodies, single-chain antibody molecules, and multispecific antibodies formed from antibody fragments (see, for example, Methods in Molecular Biology, Vol 207: Recombinant Antibodies for Cancer Therapy Methods and Protocols (2003); Chapter 1; p 3-25, Kipriyanov). Other known fragments include, but are not limited to, scFab fragments (Hust et al., BMC Biotechnology (2007), 7:14). In one embodiment, an antibody fragment comprises an antigen binding site of the intact antibody and thus retains the ability to bind antigen. In another embodiment, an antibody fragment, for example one that comprises the Fc region, retains at least one of the biological functions normally associated with the Fc region when present in an intact antibody, such as FcRn binding, antibody half life modulation, ADCC function and complement binding. In one embodiment, an antibody fragment is a monovalent antibody that has an in vivo half life substantially similar to an intact antibody. For example, such an antibody fragment may comprise on antigen binding arm linked to an Fc sequence capable of conferring in vivo stability to the fragment. For another example, an antibody fragment or antibody portion refers to any portion of a full-length antibody that is less than full length but contains at least a portion of the variable region of the antibody sufficient to form an antigen binding site (e.g. one or more CDRs) and thus retains the a binding specificity and/or an activity of the full-length antibody; antibody fragments include antibody derivatives produced by enzymatic treatment of full-length antibodies, as well as synthetically, e.g. recombinantly produced derivatives.

A "dsFv" refers to an Fv with an engineered intermolecular disulfide bond, which stabilizes the VH-VL pair.

A "Fd fragment" refers to a fragment of an antibody containing a variable domain (VH) and one constant region domain (CH1) of an antibody heavy chain.

A "Fab fragment" refers to an antibody fragment that contains the portion of the full-length antibody that would results from digestion of a full-length immunoglobulin with papain, or a fragment having the same structure that is produced synthetically, e.g. recombinantly.

A Fab fragment contains a light chain (containing a VL and CL portion) and another chain containing a variable domain of a heavy chain (VH) and one constant region domain portion of the heavy chain (CH1); it can be recombinantly produced.

A "F(ab')2 fragment" refers to an antibody fragment that results from digestion of an immunoglobulin with pepsin at pH 4.0-4.5, or a synthetically, e.g. recombinantly, produced antibody having the same structure. The F(ab')2 fragment contains two Fab fragments but where each heavy chain portion contains an additional few amino acids, including cysteine residues that form disulfide linkages joining the two fragments; it can be recombinantly produced.

A "Fab' fragment" refers to a fragment containing one half (one heavy chain and one light chain) of the F(ab')2 fragment.

A "Fd' fragment" refers to a fragment of an antibody containing one heavy chain portion of a F(ab')2 fragment.

A "Fv' fragment" refers to a fragment containing only the VH and VL domains of an antibody molecule.

A "scFv fragment" refers to an antibody fragment that contains a variable light chain (VL) and variable heavy chain (VH), covalently connected by a polypeptide linker in any order. The linker is of a length such that the two variable domains are bridged without substantial interference. Exemplary linkers are (Gly-Ser)n residues with some Glu or Lys residues dispersed throughout to increase solubility.

Diabodies are dimeric scFv; diabodies typically have shorter peptide linkers than scFvs, and they preferentially dimerize.

"HsFv" refers to antibody fragments in which the constant domains normally present in a Fab fragment have been substituted with a heterodimeric coiled-coil domain (see, e.g., Arndt et al. (2001) J Mol Biol. 7:312:221-228).

"Hypervariable region", "HVR", or "HV", as well as "complementary determining region" or "CDR", may refer to the regions of an antibody variable domain which are hypervariable in sequence and/or form structurally defined loops. Generally, antibodies comprise six hypervariable or CDR regions; three in the VH (H1, H2, H3), and three in the VL (L1, L2, L3). A number of hypervariable region or CDR delineations are in use and are encompassed herein. The Kabat Complementarity Determining Regions (Kabat CDRs) are based on sequence variability and are the most commonly used (Kabat et al., *Sequences of Proteins of Immunological Interest*, 5th Ed. Public Health Service, National Institutes of Health, Bethesda, Md. (1991)). Chothia refers instead to the location of the structural loops (Chothia and Lesk, J. Mol. Biol. 196:901-917 (1987)). The AbM hypervariable regions represent a compromise between the Kabat CDRs and Chothia structural loops, (Chothia "CDRs") and are used by Oxford Molecular's AbM antibody modeling software. The "contact" hypervariable regions are based on an analysis of the available complex crystal structures. The residues from each of these hypervariable regions are noted below.

| Loop | Kabat | AbM | Chothia | Contact |
|------|-------|-----|---------|---------|
| L1 | L24-L34 | L24-L34 | L26-L32 | L30-L36 |
| L2 | L50-L56 | L50-L56 | L50-L52 | L46-L55 |
| L3 | L89-L97 | L89-L97 | L91-L96 | L89-L96 |
| H1 | H31-H35B | H26-H35B (Kabat Numbering) | H26-H32 | H30-H35B |
| H1 | H31-H35 | H26-H35 (Chothia Numbering) | H26-H32 | H30-H35 |
| H2 | H50-H65 | H50-H58 | H53-H55 | H47-H58 |
| H3 | H95-H102 | H95-H102 | H96-H101 | H93-H101 |

IMGT referes to the international ImMunoGeneTics Information System, as described by Lefrace et al., Nucl. Acids. Res. 37; D1006-D1012 (2009), including for example, IMGT designated CDRs for antibodies.

Hypervariable regions may comprise "extended hypervariable regions" as follows: 24-36 or 24-34 (L1), 46-56 or 50-56 (L2) and 89-97 (L3) in the VL and 26-35 (H1), 50-65 or 49-65 (H2) and 93-102, 94-102 or 95-102 (H3) in the VH. The variable domain residues are numbered according to Kabat et al., Supra for each of these definitions.

"Framework" or "FR" residues are those variable domain residues other than the hypervariable region residues as herein defined. "Framework regions" (FRs) are the domains within the antibody variable region domains comprising framework residues that are located within the beta sheets; the FR regions are comparatively more conserved, in terms of their amino acid sequences, than the hypervariable regions.

"Monoclonal antibody" refers to an antibody from a population of substantially homogeneous antibodies, that is, for example, the individual antibodies comprising the population are identical and/or bind the same epitope(s), except for possible variants that may arise during production of the monoclonal antibody, such variants generally being present in minor amounts. Such monoclonal antibody typically includes an antibody comprising a polypeptide sequence that binds a target, wherein the target-binding polypeptide sequence was obtained by a process that includes the selection of a single target binding polypeptide sequence from a plurality of polypeptide sequences. For example, the selection process can be the selection of a unique clone from a plurality of clones, such as a pool of hybridoma clones, phage clones or recombinant DNA clones. It should be understood that the selected target binding sequence can be further altered, for example, to improve affinity for the target, to humanize the target binding sequence, to improve its production in cell culture, to reduce its immunogenicity in vivo, to create a multispecific antibody, etc., and that an antibody comprising the altered target binding sequence is also a monoclonal antibody of this disclosure. In contrast to polyclonal antibody preparations which typically include different antibodies directed against different determinants (e.g., epitopes), each monoclonal antibody of a monoclonal antibody preparation is directed against a single determinant on an antigen. In addition to their specificity, the monoclonal antibody preparations are advantageous in that they are typically uncontaminated by other immunoglobulins. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present disclosure may be made by a variety of techniques, including, for example, the hybridoma method (e.g., Kohler et al., Nature, 256:495 (1975); Harlow et al., Antibodies: A Laboratory Manual, (Cold Spring Harbor Laboratory Press, 2nd ed. 1988); Hammerling et al., in: Monoclonal Antibodies and T-Cell Hybridomas 563-681, (Elsevier, N.Y., 1981)), recombinant DNA methods (see, e.g., U.S. Pat. No. 4,816,567), phage display technologies (see, e.g., Clackson et al., Nature, 352:624-628 (1991); Marks et al., J. Mol. Biol., 222:581-597 (1991); Sidhu et al., J. Mol. Biol. 338(2):299-310 (2004); Lee et al., J. Mol. Biol. 340(5):1073-1093 (2004); Fellouse, Proc. Nat. Acad. Sci. USA 101(34):12467-12472 (2004); and Lee et al. J. Immunol. Methods 284(1-2):119-132 (2004), and technologies for producing human or human-like antibodies in animals that have parts or all of the human immunoglobulin loci or genes encoding human immunoglobulin sequences (see, e.g., WO 1998/24893; WO 1996/34096; WO 1996/33735; WO 1991/10741; Jakobovits et al., Proc. Natl. Acad. Sci. USA, 90:2551 (1993); Jakobovits et al., Nature, 362:255-258 (1993); Bruggemann et al., Year in Immuno., 7:33 (1993); U.S. Pat. Nos. 5,545,806; 5,569,825; 5,591,669; 5,545,807; WO 1997/17852; U.S. Pat. Nos. 5,545,807; 5,545,806; 5,569,825; 5,625,126; 5,633,425; and 5,661,016; Marks et al., Bio/Technology, 10: 779-783 (1992); Lonberg et al., Nature, 368: 856-859 (1994); Morrison, Nature, 368: 812-813 (1994); Fishwild et al., Nature Biotechnology, 14: 845-851 (1996); Neuberger, Nature Biotechnology, 14: 826 (1996); and Lonberg and Huszar, Intern. Rev. Immunol., 13: 65-93 (1995)).

"Humanized" or "Human engineered" forms of non-human (e.g., murine) antibodies are chimeric antibodies that contain amino acids represented in human immunoglobulin sequences, including, for example, wherein minimal sequence is derived from non-human immunoglobulin. For example, humanized antibodies may be human antibodies in which some hypervariable region residues and possibly some FR residues are substituted by residues from analogous sites in non-human (e.g., rodent) antibodies. Alternatively, humanized or human engineered antibodies may be non-human (e.g., rodent) antibodies in which some residues are substituted by residues from analogious sites in human antibodies (see, e.g., U.S. Pat. No. 5,766,886). Humanized antibodies include human immunoglobulins (recipient antibody) in which residues from a hypervariable region of the recipient are replaced by residues from a hypervariable region of a non-human species (donor antibody) such as mouse, rat, rabbit or nonhuman primate having the desired specificity, affinity, and capacity. In some instances, framework region (FR) residues of the human immunoglobulin are replaced by corresponding non-human residues. Furthermore, humanized antibodies may comprise residues that are not found in the recipient antibody or in the donor antibody, including, for example non-antibody sequences such as a chemokine, growth factor, peptide, cytokine, cell surface protein, serum protein, toxin, extracellular matrix protein, clotting factor, or secreted protein sequence. These modifications may be made to further refine antibody performance. Humanized antibodies include human engineered antibodies, for example, as described by U.S. Pat. No. 5,766,886, including methods for preparing modified antibody variable domains. A humanized antibody may comprise substantially all of at least one, and typically two, variable domains, in which all or substantially all of the hypervariable loops correspond to those of a non-human immunoglobulin and all or substantially all of the FRs are those of a human immunoglobulin sequence. A humanized antibody optionally may also comprise at least a portion of an immunoglobulin constant region (Fc), typically that of a human immunoglobulin. For further details, see Jones et al., Nature 321: 522-525 (1986); Riechmann et al., Nature 332:323-329 (1988); and Presta, Curr. Op. Struct. Biol. 2:593-596 (1992). See also the following review articles and references cited therein: Vaswani and Hamilton, Ann. Allergy, Asthma & Immunol. 1: 105-115 (1998); Harris, Biochem. Soc. Transactions 23:1035-1038 (1995); Hurle and Gross, Curr. Op. Biotech. 5:428-433 (1994).

"Hybrid antibodies" refer to immunoglobulin molecules in which pairs of heavy and light chains from antibodies with different antigenic determinant regions are assembled together so that two different epitopes or two different antigens can be recognized and bound by the resulting tetramer.

"Chimeric" antibodies (immunoglobulins) have a portion of the heavy and/or light chain identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (see e.g., Morrison et al., Proc. Natl. Acad. Sci. USA 81:6851-6855 (1984)). Humanized antibody refers to a subset of chimeric antibodies.

"Single-chain Fv" or "scFv" antibody fragments may comprise the VH and VL domains of antibody, wherein these domains are present in a single polypeptide chain. Generally, the scFv polypeptide further comprises a polypeptide linker between the VH and VL domains which enables the scFv to form the desired structure for antigen binding. For a review of scFv, see e.g., Pluckthun, in The Pharmacology of Monoclonal Antibodies, vol. 113, Rosenburg and Moore eds., Springer-Verlag, New York, pp. 269-315 (1994).

An "antigen" refers to a predetermined antigen to which an antibody can selectively bind. The target antigen may be polypeptide, carbohydrate, nucleic acid, lipid, hapten or other naturally occurring or synthetic compound. Preferably, the target antigen is a polypeptide.

"Epitope" or "antigenic determinant", used interchangeably herein, refer to that portion of an antigen capable of being recognized and specifically bound by a particular antibody. When the antigen is a polypeptide, epitopes can be formed both from contiguous amino acids and noncontiguous amino acids juxtaposed by tertiary folding of a protein. Epitopes formed from contiguous amino acids are typically retained upon protein denaturing, whereas epitopes formed by tertiary folding are typically lost upon protein denaturing. An epitope typically includes at least 3, and more usually, at least 5 or 8-10 amino acids in a unique spatial conformation.

Antibodies may bind to the same or a different epitope on an antigen. Antibodies may be characterized in different epitope bins. Whether an antibody binds to the same or different epitope as another antibody (e.g., a reference antibody or benchmark antibody) may be determined by competition between antibodies in assays (e.g., competitive binding assays).

Competition between antibodies may be determined by an assay in which the immunoglobulin under test inhibits specific binding of a reference antibody to a common antigen. Numerous types of competitive binding assays are known, for example: solid phase direct or indirect radioimmunoassay (RIA), solid phase direct or indirect enzyme immunoassay or enzyme-linked immunosorbent assay (EIA or ELISA), sandwich competition assay including an ELISA assay (see Stahli et al., Methods in Enzymology 9:242-253 (1983)); solid phase direct biotin-avidin EIA (see Kirkland et al., J. Immunol. 137:3614-3619 (1986)); solid phase direct labeled assay, solid phase direct labeled sandwich assay (see Harlow and Lane, "Antibodies, A Laboratory Manual," Cold Spring Harbor Press (1988)); solid phase direct label RIA using 1-125 label (see Morel et al., Molec. Immunol. 25(1): 7-15 (1988)); solid phase direct biotin-avidin EIA (Cheung et al., Virology 176:546-552 (1990)); and direct labeled RIA (Moldenhauer et al., Scand. J. Immunol., 32:77-82 (1990)). Competition binding assays may be performed using Surface Plasmon Resonance (SPR), for example, with a Biacore® instrument for kinetic analysis of binding interactions. In such an assay, a humanized antibody comprising an ultralong CDR3 of unknown epitope specificity may be evaluated for its ability to compete for binding against a comparator antibody (e.g., a BA1 or BA2 antibody as described herein). An assay may involve the use of purified antigen bound to a solid surface or cells bearing either of these, an unlabeled test immunoglobulin and a labeled reference immunoglobulin. Competitive inhibition may be measured by determining the amount of label bound to the solid surface or cells in the presence of the test immunoglobulin. Usually the test immunoglobulin is present in excess. An assay (competing antibodies) may include antibodies binding to the same epitope as the reference antibody and antibodies binding to an adjacent epitope sufficiently proximal to the epitope bound by the reference antibody for steric hindrance to occur. Usually, when a competing antibody is present in excess, it will inhibit specific binding of a reference antibody to a common antigen by at least 50%, or at least about 70%, or at least about 80%, or at least about 90%, or at least about 95%, or at least about 99% or about 100% for a competitor antibody.

That an antibody "selectively binds" or "specifically binds" means that the antibody reacts or associates more frequently, more rapidly, with greater duration, with greater affinity, or with some combination of the above to an antigen or an epitope than with alternative substances, including unrelated proteins. "Selectively binds" or "specifically binds" may mean, for example, that an antibody binds to a protein with a $K_D$ of at least about 0.1 mM, or at least about 1 μM or at least about 0.1 μM or better, or at least about 0.01 μM or better. Because of the sequence identity between homologous proteins in different species, specific binding can include an antibody that recognizes a given antigen in more than one species.

"Non-specific binding" and "background binding" when used in reference to the interaction of an antibody and a protein or peptide refer to an interaction that is not dependent on the presence of a particular structure (e.g., the antibody is binding to proteins in general rather that a particular structure such as an epitope).

"Diabodies" refer to small antibody fragments with two antigen-binding sites, which fragments comprise a heavy-chain variable domain (VH) connected to a light-chain variable domain (VL) in the same polypeptide chain (VH-VL). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et. al., Proc. Natl. Acad. Sci. USA, 90:6444-6448 (1993).

A "human antibody" refers to one which possesses an amino acid sequence which corresponds to that of an antibody produced by a human and/or has been made using any of the techniques for making human antibodies as disclosed herein. This definition of a human antibody specifically excludes a humanized antibody comprising non-human antigen-binding residues.

An "affinity matured" antibody refers to one with one or more alterations in one or more CDRs thereof which result in an improvement in the affinity of the antibody for antigen, compared to a parent antibody which does not possess those alteration(s). Preferred affinity matured antibodies will have nanomolar or even picomolar affinities for the target antigen. Affinity matured antibodies are produced by procedures known in the art. Marks et al., Bio/Technology 10:779-783 (1992) describes affinity maturation by VH and VL domain shuffling. Random mutagenesis of CDR and/or framework residues is described by: Barbas et al., Proc Nat. Acad. Sci. USA 91:3809-3813 (1994); Schier et al., Gene 169:147-155 (1995); Yelton et al., J. Immunol. 155:1994-2004 (1995); Jackson et al., J. Immunol. 154(7):3310-9 (1995); and Hawkins et al., J. Mol. Biol. 226:889-896 (1992).

Antibody "effector functions" refer to those biological activities attributable to the Fc region (a native sequence Fc region or amino acid sequence variant Fc region) of an antibody, and vary with the antibody isotype. Examples of antibody effector functions include: C1q binding and complement dependent cytotoxicity; Fc receptor binding; antibody-dependent cell-mediated cytotoxicity (ADCC);

phagocytosis; down regulation of cell surface receptors (e.g. B cell receptor); and B cell activation.

"Antibody-dependent cell-mediated cytotoxicity" or "ADCC" refers to a form of cytotoxicity in which secreted Ig bound onto Fc receptors (FcRs) present on certain cytotoxic cells (e.g., Natural Killer (NK) cells, neutrophils, and macrophages) enable these cytotoxic effector cells to bind specifically to an antigen-bearing target cell and subsequently kill the target cell with cytotoxins. The antibodies "arm" the cytotoxic cells and are absolutely required for such killing. The primary cells for mediating ADCC, NK cells, express FcγRIII only, whereas monocytes express FcγRI, FcγRII and FcγRIII. FcR expression on hematopoietic cells' is summarized in Table 3 on page 464 of Ravetch and Kinet, Annu. Rev. Immunol 9:457-92 (1991). To assess ADCC activity of a molecule of interest, an in vitro ADCC assay, may be performed. Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al. Proc. Natl. Acad. Sci. USA 95:652-656 (1998).

"Human effector cells" are leukocytes which express one or more FcRs and perform effector functions. Preferably, the cells express at least FcγRIII and perform ADCC effector function. Examples of human leukocytes which mediate ADCC include peripheral blood mononuclear cells (PBMC), natural killer (NK) cells, monocytes, cytotoxic T cells and neutrophils; with PBMCs and NK cells being preferred. The effector cells may be isolated from a native source, e.g., from blood.

"Fc receptor" or "FcR" describes a receptor that binds to the Fc region of an antibody. The preferred FcR is a native sequence human FcR. Moreover, a preferred FcR is one which binds an IgG antibody (a gamma receptor) and includes receptors of the FcγRI, FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. Activating receptor FcγRIIA contains an immunoreceptor tyrosine-based activation motif (ITAM) in its cytoplasmic domain. Inhibiting receptor FcγRIIB contains an immunoreceptor tyrosine-based inhibition motif (ITIM) in its cytoplasmic domain. (see review M. in Daeron, Annu. Rev. Immunol. 15:203-234 (1997)). FcRs are reviewed in Ravetch and Kinet, Annu. Rev. Immunol 9:457-92 (1991); Capel et al., Immunomethods 4:25-34 (1994); and de Haas et al., J. Lab. Clin. Med. 126:330-41 (1995). Other FcRs, including those to be identified in the future, are encompassed by the term "FcR" herein. The term also includes the neonatal receptor, FcRn, which is responsible for the transfer of maternal IgGs to the fetus (Guyer et al., J. Immunol. 117:587 (1976) and Kim et al., J. Immunol. 24:249 (1994)) and regulates homeostasis of immunoglobulins. For example, antibody variants with improved or diminished binding to FcRs have been described (see, e.g., Shields et al. J. Biol. Chem. 9(2): 6591-6604 (2001)).

Methods of measuring binding to FcRn are known (see, e.g., Ghetie 1997, Hinton 2004). Binding to human FcRn in vivo and serum half life of human FcRn high affinity binding polypeptides can be assayed, e.g., in transgenic mice or transfected human cell lines expressing human FcRn, or in primates administered with the Fc variant polypeptides.

"Complement dependent cytotoxicity" or "CDC" refers to the lysis of a target cell in the presence of complement. Activation of the classical complement pathway is initiated by the binding of the first component of the complement system (C1q) to antibodies (of the appropriate subclass) which are bound to their cognate antigen. To assess complement activation, a CDC assay, for example, as described in Gazzano-Santoro et al., J. Immunol. Methods 202:163 (1996), may be performed.

Polypeptide variants with altered Fc region amino acid sequences and increased or decreased C1q binding capability have been described (e.g., see, also, Idusogie et al. J. Immunol. 164: 4178-4184 (2000)).

"Fc region-comprising polypeptide" refers to a polypeptide, such as an antibody or immunoadhesin (see definitions below), which comprises an Fc region. The C-terminal lysine (residue 447 according to the EU numbering system) of the Fc region may be removed, for example, during purification of the polypeptide or by recombinant engineering the nucleic acid encoding the polypeptide.

"Blocking" antibody or an "antagonist" antibody refers to one which inhibits or reduces biological activity of the antigen it binds. Preferred blocking antibodies or antagonist antibodies substantially or completely inhibit the biological activity of the antigen.

"Agonist" antibody refers to an antibody which mimics (e.g., partially or fully) at least one of the functional activities of a polypeptide of interest.

"Acceptor human framework" refers to a framework comprising the amino acid sequence of a VL or VH framework derived from a human immunoglobulin framework, or from a human consensus framework. An acceptor human framework "derived from" a human immunoglobulin framework or human consensus framework may comprise the same amino acid sequence thereof, or may contain pre-existing amino acid sequence changes. Where pre-existing amino acid changes are present, preferably no more than 5 and preferably 4 or less, or 3 or less, pre-existing amino acid changes are present.

A "human consensus framework" refers to a framework which represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup as in Kabat et al., Sequences of Proteins of Immunological Interest, Fifth Edition, NIH Publication 91-3242, Bethesda Md. (1991), vols. 1-3. In one embodiment, for the VL, the subgroup is subgroup kappa I as in Kabat et al., supra. In one embodiment, for the VH, the subgroup is subgroup III as in Kabat et al., supra.

"Disorder" or "disease" refers to any condition that would benefit from treatment with a substance/molecule (e.g., a humanized antibody comprising an ultralong CDR3 as disclosed herein) or method disclosed herein. This includes chronic and acute disorders or diseases including those pathological conditions which predispose the mammal to the disorder in question.

"Treatment" refers to clinical intervention in an attempt to alter the natural course of the individual or cell being treated, and can be performed either for prophylaxis or during the course of clinical pathology. Desirable effects of treatment include preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, antibodies disclosed herein are used to delay development of a disease or disorder.

"Individual" (e.g., a "subject") refers to a vertebrate, preferably a mammal, more preferably a human. Mammals include, but are not limited to, farm animals (such as cows), sport animals, pets (such as cats, dogs and horses), primates, mice and rats.

"Mammal" for purposes of treatment refers to any animal classified as a mammal, including humans, rodents (e.g., mice and rats), and monkeys; domestic and farm-animals; and zoo, sports, laboratory, or pet animals, such as dogs, cats, cattle, horses, sheep, pigs, goats, rabbits, etc. In some embodiments, the mammal is selected from a human, rodent, or monkey.

"Pharmaceutically acceptable" refers to approved or approvable by a regulatory agency of the Federal or a state government or listed in the U.S. Pharmacopeia or other generally recognized pharmacopeia for use in animals, including humans.

"Pharmaceutically acceptable salt" refers to a salt of a compound that is pharmaceutically acceptable and that possesses the desired pharmacological activity of the parent compound.

"Pharmaceutically acceptable excipient, carrier or adjuvant" refers to an excipient, carrier or adjuvant that can be administered to a subject, together with at least one antibody of the present disclosure, and which does not destroy the pharmacological activity thereof and is nontoxic when administered in doses sufficient to deliver a therapeutic amount of the compound.

"Pharmaceutically acceptable vehicle" refers to a diluent, adjuvant, excipient, or carrier with which at least one antibody of the present disclosure is administered.

"Providing a prognosis", "prognostic information", or "predictive information" refer to providing information, including for example the presence of cancer cells in a subject's tumor, regarding the impact of the presence of cancer (e.g., as determined by the diagnostic methods of the present disclosure) on a subject's future health (e.g., expected morbidity or mortality, the likelihood of getting cancer, and the risk of metastasis).

Terms such as "treating" or "treatment" or "to treat" or "alleviating" or "to alleviate" refer to both 1) therapeutic measures that cure, slow down, lessen symptoms of, and/or halt progression of a diagnosed pathologic condition or disorder and 2) prophylactic or preventative measures that prevent and/or slow the development of a targeted pathologic condition or disorder. Thus those in need of treatment include those already with the disorder; those prone to have the disorder; and those in whom the disorder is to be prevented.

"Providing a diagnosis" or "diagnostic information" refers to any information, including for example the presence of cancer cells, that is useful in determining whether a patient has a disease or condition and/or in classifying the disease or condition into a phenotypic category or any category having significance with regards to the prognosis of or likely response to treatment (either treatment in general or any particular treatment) of the disease or condition. Similarly, diagnosis refers to providing any type of diagnostic information, including, but not limited to, whether a subject is likely to have a condition (such as a tumor), whether a subject's tumor comprises cancer stem cells, information related to the nature or classification of a tumor as for example a high risk tumor or a low risk tumor, information related to prognosis and/or information useful in selecting an appropriate treatment. Selection of treatment can include the choice of a particular chemotherapeutic agent or other treatment modality such as surgery or radiation or a choice about whether to withhold or deliver therapy.

A "human consensus framework" refers to a framework which represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup as in Kabat et al., Sequences of Proteins of Immunological Interest, Fifth Edition, NIH Publication 91-3242, Bethesda Md. (1991), vols. 1-3. In one embodiment, for the VL, the subgroup is subgroup kappa I as in Kabat et al., supra. In one embodiment, for the VH, the subgroup is subgroup III as in Kabat et al., supra.

An "acceptor human framework" for the purposes herein refers to a framework comprising the amino acid sequence of a light chain variable domain (VL) framework or a heavy chain variable domain (VH) framework derived from a human immunoglobulin framework or a human consensus framework, as defined below. An acceptor human framework "derived from" a human immunoglobulin framework or a human consensus framework may comprise the same amino acid sequence thereof, or it may contain amino acid sequence changes. In some embodiments, the number of amino acid changes are 10 or less, 9 or less, 8 or less, 7 or less, 6 or less, 5 or less, 4 or less, 3 or less, or 2 or less. In some embodiments, the VL acceptor human framework is identical in sequence to the VL human immunoglobulin framework sequence or human consensus framework sequence.

"Antigen-binding site" refers to the interface formed by one or more complementary determining regions. An antibody molecule has two antigen combining sites, each containing portions of a heavy chain variable region and portions of a light chain variable region. The antigen combining sites can contain other portions of the variable region domains in addition to the CDRs.

An "antibody light chain" or an "antibody heavy chain" refers to a polypeptide comprising the VL or VH, respectively. The VL is encoded by the minigenes V (variable) and J (junctional), and the VH by minigenes V, D (diversity), and J. Each of VL or VH includes the CDRs as well as the framework regions. In this application, antibody light chains and/or antibody heavy chains may, from time to time, be collectively referred to as "antibody chains." These terms encompass antibody chains containing mutations that do not disrupt the basic structure of VL or VH, as one skilled in the art will readily recognize.

"Native antibodies" refer to naturally occurring immunoglobulin molecules with varying structures. For example, native IgG antibodies are heterotetrameric glycoproteins of about 150,000 daltons, composed of two identical light chains and two identical heavy chains that are disulfide bonded. From N- to C-terminus, each heavy chain has a variable region (V H), also called a variable heavy domain or a heavy chain variable domain, followed by three constant domains (CH1, CH2, and CH3). Similarly, from N- to C-terminus, each light chain has a variable region (V L), also called a variable light domain or a light chain variable domain, followed by a constant light (CL) domain. The light chain of an antibody may be assigned to one of two types, called kappa (κ) and lambda (λ), based on the amino acid sequence of its constant domain.

"Combinatorial library" refers to collections of compounds formed by reacting different combinations of interchangeable chemical "building blocks" to produce a collection of compounds based on permutations of the building blocks. For an antibody combinatorial library, the building blocks are the component V, D and J regions (or modified forms thereof) from which antibodies are formed. For purposes herein, the terms "library" or "collection" are used interchangeably.

A "combinatorial antibody library" refers to a collection of antibodies (or portions thereof, such as Fabs), where the antibodies are encoded by nucleic acid molecules produced by the combination of V, D and J gene segments, particularly human V, D and J germline segments. The combinatorial libraries herein typically contain at least 50 different antibody (or antibody portions or fragment) members, typically at or about 50, 100, 500, 103, 1×103, 2×103, 3×103, 4×103, 5×103, 6×103, 7×103, 8×103, 9×103, 1×104, 2×104, 3×104, 4×104, 5×104, 6×104, 7×104, 8×104, 9×104, 1×105, 2×105, 3×105, 4×105, 5×105, 6×105, 7×105, 8×105, 9×105, 106, 107, 108, 109, 1010, or more different members. The resulting libraries or collections of antibodies or portions thereof, can be screened for binding to a target protein or modulation of a functional activity.

A "human combinatorial antibody library" refers to a collection of antibodies or portions thereof, whereby each member contains a VL and VH chains or a sufficient portion thereof to form an antigen binding site encoded by nucleic acid containing human germline segments produced as described herein.

A "variable germline segment" refers to V, D and J groups, subgroups, genes or alleles thereof. Gene segment sequences are accessible from known database (e.g., National Center for Biotechnology Information (NCBI), the international ImMunoGeneTics information System® (IMGT), the Kabat database and the Tomlinson's VBase database (Lefranc (2003) Nucleic Acids Res., 31:307-310; Martin et al., Bioinformatics Tools for Antibody Engineering in Handbook of Therapeutic Antibodies, Wiley-VCH (2007), pp. 104-107). Tables 3-5 list exemplary human variable germline segments. Sequences of exemplary VH, DH, JH, Vκ, Jκ, Vλ and or Jλ, germline segments are set forth in SEQ ID NOS: 10-451 and 868. For purposes herein, a germline segment includes modified sequences thereof, that are modified in accord with the rules of sequence compilation provided herein to permit practice of the method. For example, germline gene segments include those that contain one amino acid deletion or insertion at the 5' or 3' end compared to any of the sequences of nucleotides set forth in SEQ ID NOS: 10-451, 868.

"Compilation," "compile," "combine," "combination," "rearrange," "rearrangement," or other similar terms or grammatical variations thereof refers to the process by which germline segments are ordered or assembled into nucleic acid sequences representing genes. For example, variable heavy chain germline segments are assembled such that the VH segment is 5' to the DH segment which is 5' to the JH segment, thereby resulting in a nucleic acid sequence encoding a VH chain. Variable light chain germline segments are assembled such that the VL segment is 5' to the JL segment, thereby resulting in a nucleic acid sequence encoding a VL chain. A constant gene segment or segments also can be assembled onto the 3' end of a nucleic acid encoding a VH or VL chain.

"Linked," or "linkage" or other grammatical variations thereof with reference to germline segments refers to the joining of germline segments. Linkage can be direct or indirect. Germline segments can be linked directly without additional nucleotides between segments, or additional nucleotides can be added to render the entire segment in-frame, or nucleotides can be deleted to render the resulting segment in-frame. It is understood that the choice of linker nucleotides is made such that the resulting nucleic acid molecule is in-frame and encodes a functional and productive antibody.

"In-frame" or "linked in-frame" with reference to linkage of human germline segments means that there are insertions and/or deletions in the nucleotide germline segments at the joined junctions to render the resulting nucleic acid molecule in-frame with the 5' start codon (ATG), thereby producing a "productive" or functional full-length polypeptide. The choice of nucleotides inserted or deleted from germline segments, particularly at joints joining various VD, DJ and VJ segments, is in accord with the rules provided in the method herein for V(D)J joint generation. For example, germline segments are assembled such that the VH segment is 5' to the DH segment which is 5' to the JH segment. At the junction joining the VH and the DH and at the junction joining the DH and JH segments, nucleotides can be inserted or deleted from the individual VH, DH or JH segments, such that the resulting nucleic acid molecule containing the joined VDJ segments are in-frame with the 5' start codon (ATG).

A portion of an antibody includes sufficient amino acids to form an antigen binding site.

A "reading frame" refers to a contiguous and non-overlapping set of three-nucleotide codons in DNA or RNA. Because three codons encode one amino acid, there exist three possible reading frames for given nucleotide sequence, reading frames 1, 2 or 3. For example, the sequence ACTGGTCA will be ACT GGT CA for reading frame 1, A CTG GTC A for reading frame 2 and AC TGG TCA for reading frame 3. Generally for practice of the method described herein, nucleic acid sequences are combined so that the V sequence has reading frame 1.

A "stop codon" refers to a three-nucleotide sequence that signals a halt in protein synthesis during translation, or any sequence encoding that sequence (e.g. a DNA sequence encoding an RNA stop codon sequence), including the amber stop codon (UAG or TAG)), the ochre stop codon (UAA or TAA)) and the opal stop codon (UGA or TGA)). It is not necessary that the stop codon signal termination of translation in every cell or in every organism. For example, in suppressor strain host cells, such as amber suppressor strains and partial amber suppressor strains, translation proceeds through one or more stop codon (e.g. the amber stop codon for an amber suppressor strain), at least some of the time.

A "variable heavy" (VH) chain or a "variable light" (VL) chain (also termed VH domain or VL domain) refers to the polypeptide chains that make up the variable domain of an antibody. For purposes herein, heavy chain germline segments are designated as VH, DH and JH, and compilation thereof results in a nucleic acid encoding a VH chain. Light chain germline segments are designated as VL or JL, and include kappa and lambda light chains (Vκ and Jκ; Vλ and Jλ) and compilation thereof results in a nucleic acid encoding a VL chain. It is understood that a light chain is either a kappa or lambda light chain, but does not include a kappa/lambda combination by virtue of compilation of a Vκ and Jλ.

A "degenerate codon" refers to three-nucleotide codon that specifies the same amino acid as a codon in a parent nucleotide sequence. One of skill in the art is familiar with degeneracy of the genetic code and can identify degenerate codons.

"Diversity" with respect to members in a collection refers to the number of unique members in a collection. Hence, diversity refers to the number of different amino acid sequences or nucleic acid sequences, respectively, among the analogous polypeptide members of that collection. For example, a collection of polynucleotides having a diversity of 104 contains 104 different nucleic acid sequences among the analogous polynucleotide members. In one example, the provided collections of polynucleotides and/or polypeptides have diversities of at least at or about 102, 103, 104, 105, 106, 107, 108, 109, 1010 or more.

"Sequence diversity" refers to a representation of nucleic acid sequence similarity and is determined using sequence alignments, diversity scores, and/or sequence clustering. Any two sequences can be aligned by laying the sequences side-by-side and analyzing differences within nucleotides at every position along the length of the sequences. Sequence alignment can be assessed in silico using Basic Local Alignment Search Tool (BLAST), an NCBI tool for comparing nucleic acid and/or protein sequences. The use of BLAST for sequence alignment is well known to one of skill in the art. The Blast search algorithm compares two sequences and calculates the statistical significance of each match (a Blast score). Sequences that are most similar to each other will have a high Blast score, whereas sequences that are most varied will have a low Blast score.

A "polypeptide domain" refers to a part of a polypeptide (a sequence of three or more, generally 5 or 7 or more amino acids) that is a structurally and/or functionally distinguishable or definable. Exemplary of a polypeptide domain is a part of the polypeptide that can form an independently folded structure within a polypeptide made up of one or more structural motifs (e.g. combinations of alpha helices and/or beta strands connected by loop regions) and/or that is recognized by a particular functional activity, such as enzymatic activity or antigen binding. A polypeptide can have one, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of domains. For example, each heavy chain and each light chain of an antibody molecule contains a plurality of immunoglobulin (Ig) domains, each about 110 amino acids in length.

An "Ig domain" refers to a domain, recognized as such by those in the art, that is distinguished by a structure, called the Immunoglobulin (Ig) fold, which contains two beta-pleated sheets, each containing anti-parallel beta strands of amino acids connected by loops. The two beta sheets in the Ig fold are sandwiched together by hydrophobic interactions and a conserved intra-chain disulfide bond. Individual immunoglobulin domains within an antibody chain further can be distinguished based on function. For example, a light chain contains one variable region domain (VL) and one constant region domain (CL), while a heavy chain contains one variable region domain (VH) and three or four constant region domains (CH). Each VL, CL, VH, and CH domain is an example of an immunoglobulin domain.

A "variable domain" with reference to an antibody refers to a specific Ig domain of an antibody heavy or light chain that contains a sequence of amino acids that varies among different antibodies. Each light chain and each heavy chain has one variable region domain (VL, and, VH). The variable domains provide antigen specificity, and thus are responsible for antigen recognition. Each variable region contains CDRs that are part of the antigen binding site domain and framework regions (FRs).

A "constant region domain" refers to a domain in an antibody heavy or light chain that contains a sequence of amino acids that is comparatively more conserved among antibodies than the variable region domain. Each light chain has a single light chain constant region (CL) domain and each heavy chain contains one or more heavy chain constant region (CH) domains, which include, CH1, CH2, CH3 and CH4. Full-length IgA, IgD and IgG isotypes contain CH1, CH2 CH3 and a hinge region, while IgE and IgM contain CH1, CH2 CH3 and CH4. CH1 and CL domains extend the Fab arm of the antibody molecule, thus contributing to the interaction with antigen and rotation of the antibody arms. Antibody constant regions can serve effector functions, such as, but not limited to, clearance of antigens, pathogens and toxins to which the antibody specifically binds, e.g. through interactions with various cells, biomolecules and tissues.

An "antibody or portion thereof that is sufficient to form an antigen binding site" means that the antibody or portion thereof contains at least 1 or 2, typically 3, 4, 5 or all 6 CDRs of the VH and VL sufficient to retain at least a portion of the binding specificity of the corresponding full-length antibody containing all 6 CDRs. Generally, a sufficient antigen binding site at least requires CDR3 of the heavy chain (CDRH3). It typically further requires the CDR3 of the light chain (CDRL3). As described herein, one of skill in the art knows and can identify the CDRs based on Kabat or Chothia numbering (see, e.g., Kabat, E. A. et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917). For example, based on Kabat numbering, CDR-L1 corresponds to residues L24-L34; CDR-L2 corresponds to residues L50-L56; CDR-L3 corresponds to residues L89-L97; CDR-H1 corresponds to residues H31-H35, 35a or 35b depending on the length; CDR-H2 corresponds to residues H50-H65; and CDR-H3 corresponds to residues H95-H102.

A "peptide mimetic" refers to a peptide that mimics the activity of a polypeptide. For example, an erythropoietin (EPO) peptide mimetic is a peptide that mimics the activity of Epo, such as for binding and activation of the EPO receptor.

An "address" refers to a unique identifier for each locus in a collection whereby an addressed member (e.g. an antibody) can be identified. An addressed moiety is one that can be identified by virtue of its locus or location. Addressing can be effected by position on a surface, such as a well of a microplate. For example, an address for a protein in a microwell plate that is F9 means that the protein is located in row F, column 9 of the microwell plate. Addressing also can be effected by other identifiers, such as a tag encoded with a bar code or other symbology, a chemical tag, an electronic, such RF tag, a color-coded tag or other such identifier.

An "array" refers to a collection of elements, such as antibodies, containing three or more members.

A "spatial array" refers to an array where members are separated or occupy a distinct space in an array. Hence, spatial arrays are a type of addressable array. Examples of spatial arrays include microtiter plates where each well of a plate is an address in the array. Spacial arrays include any arrangement wherein a plurality of different molecules, e.g., polypeptides, are held, presented, positioned, situated, or supported. Arrays can include microtiter plates, such as 48-well, 96-well, 144-well, 192-well, 240-well, 288-well, 336-well, 384-well, 432-well, 480-well, 576-well, 672-well, 768-well, 864-well, 960-well, 1056-well, 1152-well, 1248-well, 1344-well, 1440-well, or 1536-well plates, tubes, slides, chips, flasks, or any other suitable laboratory apparatus. Furthermore, arrays can also include a plurality of sub-arrays. A plurality of sub-arrays encompasses an array where more than one arrangement is used to position the polypeptides. For example, multiple 96-well plates could constitute a plurality of sub-arrays and a single array.

An "addressable library" or "spatially addressed library" refers to a collection of molecules such as nucleic acid molecules or protein agents, such as antibodies, in which each member of the collection is identifiable by virtue of its address.

An "addressable array" refers to one in which the members of the array are identifiable by their address, the position in a spatial array, such as a well of a microtiter plate, or on a solid phase support, or by virtue of an identifiable or detectable label, such as by color, fluorescence, electronic signal (i.e. RF, microwave or other frequency that does not substantially alter the interaction of the molecules of interest), bar code or other symbology, chemical or other such label. Hence, in general the members of the array are located at identifiable loci on the surface of a solid phase or directly or indirectly linked to or otherwise associated with the identifiable label, such as affixed to a microsphere or other particulate support (herein referred to as beads) and suspended in solution or spread out on a surface.

"An addressable combinatorial antibody library" refers to a collection of antibodies in which member antibodies are identifiable and all antibodies with the same identifier, such as position in a spatial array or on a solid support, or a chemical or RF tag, bind to the same antigen, and generally are substantially the same in amino acid sequence. For purposes herein, reference to an "addressable arrayed combinatorial antibody library" means that the antibody members are addressed in an array.

"In silico" refers to research and experiments performed using a computer. In silico methods include, but are not limited to, molecular modeling studies, biomolecular docking experiments, and virtual representations of molecular structures and/or processes, such as molecular interactions. For purposes herein, the antibody members of a library can be designed using a computer program that selects component V, D and J germline segments from among those input into the computer and joins them in-frame to output a list of nucleic acid molecules for synthesis. Thus, the recombination of the components of the antibodies in the collections or libraries provided herein, can be performed in silico by combining the nucleotide sequences of each building block in accord with software that contains rules for doing so. The process could be performed manually without a computer, but the computer provides the convenience of speed.

A "database" refers to a collection of data items. For purposes herein, reference to a database is typically with reference to antibody databases, which provide a collection of sequence and structure information for antibody genes and sequences. Exemplary antibody databases include, but are not limited to, IMGT®, the international ImMunoGeneTics information system (imgt.cines.fr; see e.g., Lefranc et al. (2008) Briefings in Bioinformatics, 9:263-275), National Center for Biotechnology Information (NCBI), the Kabat database and the Tomlinson's VBase database (Lefranc (2003) Nucleic Acids Res., 31:307-310; Martin et al., Bioinformatics Tools for Antibody Engineering in Handbook of Therapeutic Antibodies, Wiley-VCH (2007), pp. 104-107). A database also can be created by a user to include any desired sequences. The database can be created such that the sequences are inputted in a desired format (e.g., in a particular reading frame; lacking stop codons; lacking signal sequences). The database also can be created to include sequences in addition to antibody sequences.

"Screening" refers to identification or selection of an antibody or portion thereof from a collection or library of antibodies and/or portions thereof, based on determination of the activity or property of an antibody or portion thereof. Screening can be performed in any of a variety of ways, including, for example, by assays assessing direct binding (e.g. binding affinity) of the antibody to a target protein or by functional assays assessing modulation of an activity of a target protein.

"Activity towards a target protein" refers to binding specificity and/or modulation of a functional activity of a target protein, or other measurements that reflects the activity of an antibody or portion thereof towards a target protein.

A "target protein" refers to candidate proteins or peptides that are specifically recognized by an antibody or portion thereof and/or whose activity is modulated by an antibody or portion thereof. A target protein includes any peptide or protein that contains an epitope for antibody recognition. Target proteins include proteins involved in the etiology of a disease or disorder by virtue of expression or activity. Exemplary target proteins are described herein.

"Hit" refers to an antibody or portion thereof identified, recognized or selected as having an activity in a screening assay.

"Iterative" with respect to screening means that the screening is repeated a plurality of times, such as 2, 3, 4, 5 or more times, until a "Hit" is identified whose activity is optimized or improved compared to prior iterations.

"High-throughput" refers to a large-scale method or process that permits manipulation of large numbers of molecules or compounds, generally tens to hundred to thousands of compounds. For example, methods of purification and screening can be rendered high-throughput. High-throughput methods can be performed manually. Generally, however, high-throughput methods involve automation, robotics or software.

Basic Local Alignment Search Tool (BLAST) is a search algorithm developed by Altschul et al. (1990) to separately search protein or DNA databases, for example, based on sequence identity. For example, blastn is a program that compares a nucleotide query sequence against a nucleotide sequence database (e.g. GenBank). BlastP is a program that compares an amino acid query sequence against a protein sequence database.

A BLAST bit score is a value calculated from the number of gaps and substitutions associated with each aligned sequence. The higher the score, the more significant the alignment.

A "human protein" refers to a protein encoded by a nucleic acid molecule, such as DNA, present in the genome of a human, including all allelic variants and conservative variations thereof. A variant or modification of a protein is a human protein if the modification is based on the wildtype or prominent sequence of a human protein.

"Naturally occurring amino acids" refer to the 20 L-amino acids that occur in polypeptides. The residues are those 20 α-amino acids found in nature which are incorporated into protein by the specific recognition of the charged tRNA molecule with its cognate mRNA codon in humans.

"Non-naturally occurring amino acids" refer to amino acids that are not genetically encoded. For example, a non-natural amino acid is an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are known to those of skill in the art.

"Nucleic acids" include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

A "peptide" refers to a polypeptide that is from 2 to 40 amino acids in length.

The amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

An "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

"Amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH2 refers to the free amino group present at the amino terminus of a polypeptide. COOH refers to the free carboxy group present at the carboxyl terminus of a polypeptide. In keeping with standard polypeptide nomenclature described in J. Biol. Chem., 243: 3552-3559 (1969), and adopted 37 C.F.R. ☐ §§ 1.821-1.822, abbreviations for amino acid residues are shown below:

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |

-continued

| SYMBOL | | |
|---|---|---|
| 1-Letter | 3-Letter | AMINO ACID |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§ 1.821-1.822, and incorporated herein by reference.

Furthermore, it should be noted that a dash at the beginning or end of an amino acid residue sequence indicates a peptide bond to a further sequence of one or more amino acid residues, to an amino-terminal group such as NH2 or to a carboxyl-terminal group such as COOH. The abbreviations for any protective groups, amino acids and other compounds, are, unless indicated otherwise, in accord with their common usage, recognized abbreviations, or the IUPAC-IUB Commission on Biochemical Nomenclature (see, (1972) Biochem. 11:1726). Each naturally occurring L-amino acid is identified by the standard three letter code (or single letter code) or the standard three letter code (or single letter code) with the prefix "L-"; the prefix "D-" indicates that the stereoisomeric form of the amino acid is D.

An "immunoconjugate" refers to an antibody conjugated to one or more heterologous molecule(s), including but not limited to a cytotoxic agent. An immunoconjugate may include non-antibody sequences.

General Techniques

The present disclosure relies on routine techniques in the field of recombinant genetics. Basic texts disclosing the general methods of use in this present disclosure include Sambrook and Russell, Molecular Cloning: A Laboratory Manual 3d ed. (2001); Kriegler, Gene Transfer and Expression: A Laboratory Manual (1990); and Ausubel et al., Current Protocols in Molecular Biology (1994).

For nucleic acids, sizes are given in either kilobases (Kb) or base pairs (bp). These are estimates derived from agarose or polyacrylamide gel electrophoresis, from sequenced nucleic acids, or from published DNA sequences. For proteins, sizes are given in kilo-Daltons (kD) or amino acid residue numbers. Proteins sizes are estimated from gel electrophoresis, from sequenced proteins, from derived amino acid sequences, or from published protein sequences.

Oligonucleotides that are not commercially available can be chemically synthesized according to the solid phase phosphoramidite triester method first described by Beaucage and Caruthers, Tetrahedron Letters, 22:1859-1862 (1981), using an automated synthesizer, as described in Van Devanter et al., Nucleic Acids Res., 12:6159-6168 (1984). Purification of oligonucleotides is by either native polyacrylamide gel electrophoresis or by anion-exchange chromatography as described in Pearson & Reanier, J. Chrom., 255:137-149 (1983). The sequence of the cloned genes and synthetic oligonucleotides can be verified after cloning using, e.g., the chain termination method for sequencing double-stranded templates of Wallace et al., Gene, 16:21-26 (1981).

The nucleic acids encoding recombinant polypeptides of the present disclosure may be cloned into an intermediate vector before transformation into prokaryotic or eukaryotic cells for replication and/or expression. The intermediate vector may be a prokaryote vector such as a plasmid or shuttle vector.

Humanized Antibodies with Ultralong CDR3 Sequences

To date, cattle are the only species where ultralong CDR3 sequences have been identified. However, other species, for example other ruminants, may also possess antibodies with ultralong CDR3 sequences.

Exemplary antibody variable region sequences comprising an ultralong CDR3 sequence identified in cattle include those designated as: BLV1H12 (see, SEQ ID NO: 22), BLV5B8 (see, SEQ ID NO: 23), BLV5D3 (see, SEQ ID NO: 24) and BLV8C11 (see, SEQ ID NO: 25) (see, e.g., Saini, et al. (1999) Eur. J. Immunol. 29: 2420-2426; and Saini and Kaushik (2002) Scand. J. Immunol. 55: 140-148); BF4E9 (see, SEQ ID NO: 26) and BF1H1 (see, SEQ ID NO: 27) (see, e.g., Saini and Kaushik (2002) Scand. J. Immunol. 55: 140-148); and F18 (see, SEQ ID NO: 28) (see, e.g., Berens, et al. (1997) Int. Immunol. 9: 189-199).

In an embodiment, bovine antibodies are identified and humanized. Multiple techniques exist to identify antibodies.

Antibodies of the present disclosure may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al. in Methods in Molecular Biology 178:1-37 (O'Brien et al., ed., Human Press, Totowa, N.J., 2001) and further described, e.g., in the McCafferty et al., Nature 348:552-554; Clackson et al., Nature 352: 624-628 (1991); Marks et al., J. Mol. Biol. 222: 581-597 (1992); Marks and Bradbury, in Methods in Molecular Biology 248:161-175 (Lo, ed., Human Press, Totowa, N.J., 2003); Sidhu et al., J. Mol. Biol. 338(2): 299-310 (2004); Lee et al., J. Mol. Biol. 340(5): 1073-1093 (2004); Fellouse, Proc. Natl. Acad. Sci. USA 101(34): 12467-12472 (2004); and Lee et al., J. Immunol. Methods 284(1-2): 119-132 (2004).

In certain phage display methods, repertoires of VH and VL genes are separately cloned by polymerase chain reaction (PCR) and recombined randomly in phage libraries, which can then be screened for antigen-binding phage as described in Winter et al., Ann. Rev. Immunol., 12: 433-455 (1994). Phage typically display antibody fragments, either as single-chain Fv (scFv) fragments or as Fab fragments. Libraries from immunized sources provide high-affinity antibodies to the immunogen without the requirement of constructing hybridomas. Phage display libraries of bovine antibodies may be a source of bovine antibody gene sequences, including ultralong CDR3 sequences.

Typically, a non-human antibody is humanized to reduce immunogenicity to humans, while retaining the specificity and affinity of the parental non-human antibody. Generally, a humanized antibody comprises one or more variable domains in which CDRs (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the CDR residues are derived), e.g., to restore or improve antibody specificity or affinity.

Humanized antibodies and methods of making them are reviewed, e.g., in Almagro and Fransson, Front. Biosci. 13:1619-1633 (2008), and are further described, e.g., in Riechmann et al., Nature 332:323-329 (1988); Queen et al., Proc. Nat'l Acad. Sci. USA 86:10029-10033 (1989); U.S. Pat. Nos. 5,821,337, 7,527,791, 6,982,321, and 7,087,409; Kashmiri et al., Methods 36:25-34 (2005) (describing SDR (a-CDR) grafting); Padlan, Mol. Immunol. 28:489-498 (1991) (describing "resurfacing"); Dall'Acqua et al., Methods 36:43-60 (2005) (describing "FR shuffling"); and Osbourn et al., Methods 36:61-68 (2005); Klimka et al., Br. J. Cancer, 83:252-260 (2000) (describing the "guided selection" approach to FR shuffling); and Studnicka et al., U.S. Pat. No. 5,766,886.

Human variable region framework sequences that may be used for humanization include but are not limited to: framework sequences selected using the "best-fit" method (see, e.g., Sims et al. J. Immunol. 151:2296 (1993)); framework sequences derived from the consensus sequence of human antibodies of a particular subgroup of light or heavy chain variable regions (see, e.g., Carter et al. Proc. Natl. Acad. Sci. USA, 89:4285 (1992); and Presta et al. J. Immunol., 151: 2623 (1993)); human mature (somatically mutated) framework sequences or human germline framework sequences (see, e.g., Almagro and Fransson, Front. Biosci. 13:1619-1633 (2008)); and framework sequences derived from screening FR libraries (see, e.g., Baca et al., Biol. Chem. 272:10678-10684 (1997) and Rosok et al., J. Biol. Chem. 271:22611-22618 (1996)).

Humanized antibodies with ultralong CDR3 sequences may also include engineered non-antibody sequences, such as cytokines or growth factors, into the CDR3 region, such that the resultant humanized antibody is effective, for example, in inhibiting tumor metastasis. Non-antibody sequences may include an interleukin sequence, a hormone sequence, a cytokine sequence, a toxin sequence, a lymphokine sequence, a growth factor sequence, a chemokine sequence, or combinations thereof. Non-antibody sequences may be human, non-human, or synthetic. In some embodiments, the cytokine or growth factor may be shown to have an antiproliferative effect on at least one cell population. Such cytokines, lymphokines, growth factors, or other hematopoietic factors include M-CSF, GM-CSF, TNF, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IFN, TNFα1, TNF1, TNF2, G-CSF, Meg-CSF, GM-CSF, thrombopoietin, stem cell factor, and erythropoietin. Additional growth factors for use in humanized antibodies and/or pharmaceutical compositions of the present disclosure include: angiogenin, bone morphogenic protein-1, bone morphogenic protein-2, bone morphogenic protein-3, bone morphogenic protein-4, bone morphogenic protein-5, bone morphogenic protein-6, bone morphogenic protein-7, bone morphogenic protein-8, bone morphogenic protein-9, bone morphogenic protein-10, bone morphogenic protein-11, bone morphogenic protein-12, bone morphogenic protein-13, bone morphogenic protein-14, bone morphogenic protein-15, bone morphogenic protein receptor IA, bone morphogenic protein receptor IB, brain derived neurotrophic factor, ciliary neutrophic factor, ciliary neutrophic factor receptor, cytokine-induced neutrophil chemotactic factor 1, cytokine-induced neutrophil, chemotactic factor 2, cytokine-induced neutrophil chemotactic factor 2, endothelial cell growth factor, endothelin 1, epidermal growth factor, epithelial-derived neutrophil attractant, fibroblast growth factor 4, fibroblast growth factor 5, fibroblast growth factor 6, fibroblast growth factor 7, fibroblast growth factor 8, fibroblast growth factor 8b, fibroblast growth factor 8c, fibroblast growth factor 9, fibroblast growth factor 10, fibroblast growth factor acidic, fibroblast growth factor basic, glial cell line-derived neutrophic factor receptor-1, glial cell line-derived neutrophic factor receptor-2, growth related protein, growth related protein-1, growth related protein-2, growth related protein-3, heparin binding epidermal growth factor, hepatocyte growth factor, hepatocyte growth factor receptor, insulin-like growth factor I, insulin-like growth factor receptor, insulin-like growth factor II, insulin-like growth factor binding protein, keratinocyte growth factor, leukemia inhibitory factor, leukemia inhibitory factor receptor-1, nerve growth factor nerve growth factor receptor, neurotrophin-3, neurotrophin-4, placenta growth factor, placenta growth factor 2, platelet-derived endothelial cell growth factor, platelet derived growth factor, platelet derived growth factor A chain, platelet derived growth factor AA, platelet derived growth factor AB, platelet derived growth factor B chain, platelet derived growth factor BB, platelet derived growth factor receptor-1, platelet derived growth factor receptor-2, pre-B cell growth stimulating factor, stem cell factor, stem cell factor receptor, transforming growth factor-1, transforming growth factor-2, transforming growth factor-1, transforming growth factor-1.2, transforming growth factor-2, transforming growth factor-3, transforming growth factor-S, latent transforming growth factor-1, transforming growth factor-1 binding protein I, transforming growth factor-1 binding protein II, transforming growth factor-1 binding protein III, tumor necrosis factor receptor type I, tumor necrosis factor receptor type II, urokinase-type plasminogen activator receptor, vascular endothelial growth factor, and chimeric proteins and biologically or immunologically active fragments thereof. Exemplary hormone sequences include a glucagon-like peptide-1 (GLP-1), Melatonin (MT), Thyroxine (T4), Triiodothyronine (T3), Adrenaline (EPI), Noradrenaline (NRE), Dopamine (DA), Antimullerian Hormone, Adrenocorticotropic (ACTH), Angiotensin (AGT), Antidiuretic Hormone (ADH), Calcitonin (CT), Cholecystokinin (CCK), Corticotropin-releasing hormone (CRH), Erythropoietin (EPO), FollicLe-Stimulating Hormone (FSH), Gastrin (GRP), Ghrelin, Glucagon (GCG), Gonadotropin-releasing Hormone (GnRH), Growth-Hormone Releasing Hormone (GNRH), Human Chorionic Gonadotropin (hCG), Growth Hormone (GH), Insulin (INS), Insuin-like Growth Factor (or Somatomedin) (IGF), Leptin (LEP), Luteinizing Hormone (LH), Melanocyte Stimulating Hormone (MSH), Oxytocin (OXT), Parathyroid Hormone (PTH), Prolactin (PRL), Secretin (SCT), Somatostatin (SRIF), Thrombopoietin (TPO), Thyroid-Stimulating Hormone (TSH), Thyrotropin-releasing Hormone (TRH), Cortisol, Aldosterone, Testosterone, Dehydroepiandrosterone (DHEA), Estradiol (Oestrogen), Progesterone, Calcitriol (1,25-dihydroxyvitamin D3), Calcidiol (25-hydroxyvitamin D3), Prolactin releasing hormone (PRH), Lipotropin (LRH), Brain Natriuretic Peptide (BNP), Neuropeptide Y (NPY), Histamine, Endothelin, Renin, or Enkephalin. Exemplary toxin sequences include an ADWX-1 sequence, an HsTx1 sequence, an OSK1 sequence, a Pi2 sequence, a Hongotoxin (HgTX) sequence, a Margatoxin sequence, an Agitoxin-2 sequence, a Pi3 sequence, a Kaliotoxin sequence, an Anuroctoxin sequence, a Charybdotoxin sequence, a Tityustoxin-K-alpha sequence, a Maurotoxin sequence, a Ceratotoxin 1 (CcoTx1) sequence, a CcoTx2 sequence, a CcoTx3 sequence, a Phrixotoxin 3 (PaurTx3) sequence, a Hanatoxin 1 sequence, a Phrixotoxin 1 sequence, a Huwentoxin-IV sequence, an α-conotoxin ImI sequence, an α-conotoxin EpI sequence, an α-conotoxin PnIA sequence, an α-conotoxin PnIB sequence, an α-conotoxin MII sequence, an α-conotoxin AuIA sequence, an α-conotoxin AuIB sequence, an α-conotoxin AuIC sequence, a conotoxin κ-PVIIA sequence, a charybdotoxin sequence, a neurotoxin B-IV sequence, a crotamine sequence, a ω-GVIA (conotoxin) sequence, a κ-hefutoxin 1 sequence, a Css4 sequence, a Bj-xtrIT sequence, a BcIV sequence, a Hm-1 sequence, a Hm-2 sequence, a GsAF-I (β-theraphotoxin-Gr1b) sequence, a Protoxin I (ProTx-I sequence, a β-theraphotoxin-Tp1a) sequence, a Protoxin II (ProTx II) sequence, a Huwentoxin I sequence, a μ-Conotoxin PIIIA sequence, a Jingzhaotoxin-III (β-TRTX-Cj1α) sequence, a GsAF-II (Kappa-theraphotoxin-Gr2c) sequence, a ShK (Stichodactyla toxin) sequence, a HsTx1 sequence, a Guangxitoxin 1E (GxTx-1E) sequence, a Maurotoxin sequence, a Charybdotoxin (ChTX) sequence, an Iberiotoxin (IbTx) sequence, a Leiurotoxin 1 (scyllatoxin) sequence, a Tamapin sequence, a Kaliotoxin-1 (KTX) sequence, a Purotoxin 1 (PT-1) sequence, or a GpTx-1 sequence, a MOKA Toxin sequence, a OSK1 (P12, K16, D20) sequence, a OSK1 (K16, D20) sequence, a HmK sequence, a ShK (K16,Y26, K29) sequence, a ShK (K16) sequence, a ShK-A (K16) sequence, a ShK (K16,E30) sequence, a ShK (Q21) sequence, a ShK (L21) sequence, a ShK (F21) sequence, a ShK (I21) sequence, or a ShK (A21) sequence. Exemplary toxin sequences include SEQ ID NOS: 475-481, 599-655, 666-698, 727-733, 808-810 and 831-835 (see, e.g., FIG. 17). Exemplary non-antibody sequences include interleukin 8 (IL-8, SEQ ID NO: 475), interleukin 21 (IL-21, SEQ ID NO: 480), CXCL12/SDF-1alpha (SEQ ID NO: 479), somatostain (SEQ ID NO: 477), ProTx-II (SEQ ID NO: 481), chlorotoxin (SEQ ID NO: 478), and ziconotide (SEQ ID NO: 476).

A non-human antibody may be humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

The humanized antibodies comprising an ultralong CDR3 as disclosed herein are preferably monoclonal. Also encompassed within the scope of the disclosure are Fab, Fab', Fab'-SH and $F(ab')^2$ fragments of the humanized antibodies comprising an ultralong CDR3 as provided herein. These antibody fragments can be created by traditional means, such as enzymatic digestion, or may be generated by recombinant techniques. Such antibody fragments may be chimeric or humanized. These fragments are useful for the diagnostic and therapeutic purposes set forth below.

Monoclonal antibodies are obtained from a population of substantially homogeneous antibodies, e.g., the individual antibodies comprising the population are identical except for possible naturally occurring mutations that may be present in minor amounts. Thus, the modifier "monoclonal" indicates the character of the antibody as not being a mixture of discrete antibodies.

The humanized antibodies comprising an ultralong CDR3 as disclosed herein can be made using a hybridoma cell-based method first described by Kohler et al., Nature, 256:495 (1975), or may be made by recombinant DNA methods.

Hybridoma cells can be generated by fusing B cells producing a desired antibody with an immortalized cell line, usually a myeloma cell line, so that the resulting fusion cells will be an immortalized cell line that secrets a particular antibody. By the same principle, myeloma cells can be first transfected with a nucleic acid encoding a germline antibody V region and can be screened for the expression of the germline V region. Those myeloma cells with highest level of proteolytic light chain expression can be subsequently fused with B cells that produce an antibody with desired target protein specificity. The fusion cells will produce two types of antibodies: one is a heterologous antibody containing an endogenous antibody chain (either heavy or light) operably joined to the recombinant germline V region (either heavy or light), and the other is the same antibody that the parental B cells would secrete (e.g. both endogenous heavy and light chains). The operably joined heterologous heavy and light chains can be isolated by conventional methods such as chromatography and identification can be confirmed by target protein binding assays, assays identifying a unique tag of the germline polypeptide, or endopeptidase activity assays described in other sections of this disclosure. In some cases, where the heterologous antibody is the predominant type in quantity among the two types of antibodies, such isolation may not be needed.

The hybridoma cells may be seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells.

Preferred myeloma cells are those that fuse efficiently, support stable high-level production of antibody by the selected antibody-producing cells, and are sensitive to a medium such as HAT medium. Among these, myeloma cell lines may be murine myeloma lines, such as those derived from MOPC-21 and MPC-11 mouse tumors available from the Salk Institute Cell Distribution Center, San Diego, Calif. USA, and SP-2 or X63-Ag8-653 cells available from the American Type Culture Collection, Rockville, Md. USA. Human myeloma and mouse-human heteromyeloma cell lines also have been described for the production of human monoclonal antibodies (Kozbor, J. Immunol., 133:3001 (1984); Brodeur et al., Monoclonal Antibody Production Techniques and Applications, pp. 51-63 (Marcel Dekker, Inc., New York, 1987)).

Culture medium in which hybridoma cells are growing is assayed for production of humanized antibodies comprising an ultralong CDR3. For example, the binding specificity of monoclonal antibodies produced by hybridoma cells may be determined by immunoprecipitation or by an in vitro binding assay, such as an enzyme-linked immunoadsorbent assay (ELISA).

The binding affinity of the monoclonal antibody can, for example, be determined by the Scatchard analysis of Munson et al., Anal. Biochem., 107:220 (1980).

After hybridoma cells are identified that produce antibodies of the desired specificity, affinity, and/or activity, the clones may be subcloned by limiting dilution procedures and grown by standard methods (Goding, Monoclonal Antibodies: Principles and Practice, pp. 59-103 (Academic Press, 1986)). Suitable culture media for this purpose include, for example, D-MEM or RPMI-1640 medium. In addition, the hybridoma cells may be grown in vivo as ascites tumors in an animal.

The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

The humanized antibodies comprising an ultralong CDR3 as disclosed herein may be made by using combinatorial libraries to screen for synthetic antibody clones with the desired activity or activities. For example, synthetic antibody clones are selected by screening phage libraries containing phage that display various fragments of antibody variable regions (e.g., scFv or Fab) fused to phage coat protein. Such phage libraries may be panned, for example, by affinity chromatography against the desired antigen. Clones expressing antibody fragments capable of binding to the desired antigen may be adsorbed to the antigen and thus separated from the non-binding clones in the library. The binding clones may then be eluted from the antigen, and can be further enriched by additional cycles of antigen adsorption/elution. Any of the humanized antibodies comprising an ultralong CDR3 as disclosed herein may be obtained by designing a suitable antigen screening procedure to select for the phage clone of interest followed by construction of a full length antibody comprising an ultralong CDR3 clone using the VH and VL (e.g., from scFv or Fab) sequences from the phage clone of interest and suitable constant region (Fc) sequences described in Kabat et al., Sequences of Proteins of Immunological Interest, Fifth Edition, NIH Publication 91-3242, Bethesda Md. (1991), vols. 1-3.

The antigen-binding domain of an antibody is formed from two variable (V) regions, one each from the light (VL) and heavy (VH) chains, that both present three hypervariable loops or complementarity-determining regions (CDRs). Variable domains may be displayed functionally on phage, either as single-chain Fv (scFv, also referred to as single-chain antibody (SCA)) fragments, in which VH and VL are covalently linked through a short, flexible peptide, or as Fab fragments, in which they are each fused to a constant domain and interact non-covalently, as described in Winter et al., Ann. Rev. Immunol., 12: 433-455 (1994). scFv or SCA encoding phage clones and Fab encoding phage clones may be separately or collectively referred to as "Fv phage clones" or "Fv clones".

Repertoires of VH and VL genes may be separately cloned by polymerase chain reaction (PCR) and recombined randomly in phage libraries, which can then be searched for antigen-binding clones as described in Winter et al., Ann. Rev. Immunol., 12: 433-455 (1994). Libraries from immunized sources provide high-affinity antibodies to the immunogen without the requirement of constructing hybridomas. Alternatively, the naive repertoire may be cloned to provide a single source of human antibodies to a wide range of non-self and also self antigens without any immunization as described by Griffiths et al., EMBO J. 12: 725-734 (1993). Finally, naive libraries can also be made synthetically by cloning the unrearranged V-gene segments from stem cells, and using PCR primers containing random sequence to encode the highly variable CDR3 regions and to accomplish rearrangement in vitro as described by Hoogenboom and Winter, J. Mol. Biol., 227: 381-388 (1992).

Filamentous phage is used to display antibody fragments by fusion to the minor coat protein pIII. Protein pIII may include truncated forms of pIII. The antibody fragments can be displayed as single chain Fv fragments, in which VH and VL domains are connected on the same polypeptide chain by a flexible polypeptide spacer, (e.g., as described by Marks et al., J. Mol. Biol., 222: 581-597 (1991)), or as Fab fragments, in which one chain is fused to pIII (e.g., a truncated pIII) and the other is secreted into the bacterial host cell periplasm where assembly of a Fab-coat protein structure which becomes displayed on the phage surface by displacing some of the wild type coat proteins, (e.g., as described in Hoogenboom et al., Nucl. Acids Res., 19: 4133-4137 (1991)).

Nucleic acid encoding antibody variable gene segments (including VH and VL segments) are recovered from the cells of interest and may be amplified or copies made by recombinant DNA techniques (e.g., Kunkel mutagenesis). For example, in the case of rearranged VH and VL gene libraries, the desired DNA may be obtained by isolating genomic DNA or mRNA from lymphocytes followed by polymerase chain reaction (PCR) with primers matching the 5' and 3' ends of rearranged VH and VL genes as described in Orlandi et al., Proc. Natl. Acad. Sci. (USA), 86: 3833-3837 (1989), thereby making diverse V gene repertoires for expression. The V genes may be amplified from cDNA and genomic DNA, with back primers at the 5' end of the exon encoding the mature V-domain and forward primers based within the J-segment as described in Orlandi et al. (1989) and in Ward et al., Nature, 341: 544-546 (1989). For amplifying from cDNA, back primers can also be based in the leader exon as described in Jones et al., Biotechnol., 9: 88-89 (1991), and forward primers within the constant region as described in Sastry et al., Proc. Natl. Acad. Sci. (USA), 86: 5728-5732 (1989). To enhance or maximize complementarity, degeneracy may be incorporated in the primers as described in Orlandi et al. (1989) or Sastry et al. (1989). Library diversity may be enhanced or maximized by using PCR primers targeted to each V-gene family in order to amplify available VH and VL arrangements present in the immune cell nucleic acid sample, for example, as described in the method of Marks et al., J. Mol. Biol., 222: 581-597 (1991) or as described in the method of Orum et al., Nucleic Acids Res., 21: 4491-4498 (1993). For cloning of the amplified DNA into expression vectors, rare restriction may can be introduced within the PCR primer as a tag at one end as described in Orlandi et al. (1989), or by further PCR amplification with a tagged primer as described in Clackson et al., Nature, 352: 624-628 (1991).

Repertoires of synthetically rearranged V genes may be derived in vitro from V gene segments. Most of the human VH-gene segments have been cloned and sequenced (e.g., reported in Tomlinson et al., J. Mol. Biol., 227: 776-798 (1992)), and mapped (e.g., reported in Matsuda et al., Nature Genet., 3: 88-94 (1993); these cloned segments (including all the major conformations of the H1 and H2 loop) may be used to generate diverse VH gene repertoires with PCR primers encoding H3 loops of diverse sequence and length as described in Hoogenboom and Winter, J. Mol. Biol., 227: 381-388 (1992). VH repertoires may also be made with all the sequence diversity focused in a long H3 loop of a single length as described in Barbas et al., Proc. Natl. Acad. Sci. USA, 89: 4457-4461 (1992). Human Vκ and Vλ segments have been cloned and sequenced (reported in Williams and Winter, Eur. J. Immunol., 23: 1456-1461 (1993)) and can be used to make synthetic light chain repertoires. Synthetic V gene repertoires, based on a range of VH and VL folds, and L3 and H3 lengths, will encode antibodies of considerable structural diversity. Following amplification of V-gene encoding DNAs, germline V-gene segments can be rearranged in vitro according to the methods of Hoogenboom and Winter, J. Mol. Biol., 227: 381-388 (1992).

Repertoires of antibody fragments may be constructed by combining VH and VL gene repertoires together in several ways. Each repertoire may be created in different vectors, and the vectors recombined in vitro, for example, as described in Hogrefe et al., Gene, 128: 119-126 (1993), or in vivo by combinatorial infection, for example, the loxP system described in Waterhouse et al., Nucl. Acids Res., 21: 2265-2266 (1993). The in vivo recombination approach exploits the two-chain nature of Fab fragments to overcome the limit on library size imposed by E. coli transformation efficiency. Naive VH and VL repertoires are cloned separately, one into a phagemid and the other into a phage vector. The two libraries are then combined by phage infection of phagemid-containing bacteria so that each cell contains a different combination and the library size is limited only by the number of cells present (about $10^{12}$ clones). Both vectors contain in vivo recombination signals so that the VH and VL genes are recombined onto a single replicon and are co-packaged into phage virions. These large libraries may provide large numbers of diverse antibodies of good affinity ($K_d^{-1}$ of about $10^{-8}$ M).

Alternatively, the repertoires may be cloned sequentially into the same vector, for example, as described in Barbas et al., Proc. Natl. Acad. Sci. USA, 88: 7978-7982 (1991), or assembled together by PCR and then cloned, for example, as described in Clackson et al., Nature, 352: 624-628 (1991). PCR assembly may also be used to join VH and VL DNAs with DNA encoding a flexible peptide spacer to form single chain Fv (scFv) repertoires. In yet another technique, "in cell PCR assembly" may be used to combine VH and VL genes within lymphocytes by PCR and then clone repertoires of linked genes as described in Embleton et al., Nucl. Acids Res., 20: 3831-3837 (1992).

The antibodies produced by naive libraries (either natural or synthetic) can be of moderate affinity ($K_d^{-1}$ of about $10^6$ to $10^7 M^{-1}$), but affinity maturation may also be mimicked in vitro by constructing and reselecting from secondary libraries as described in Winter et al. (1994), supra. For example, mutation can be introduced at random in vitro by using error-prone polymerase (reported in Leung et al., Technique, 1: 11-15 (1989)) in the method of Hawkins et al., J. Mol. Biol., 226: 889-896 (1992) or in the method of Gram et al., Proc. Natl. Acad. Sci. USA, 89: 3576-3580 (1992). Additionally, affinity maturation may be performed by randomly mutating one or more CDRs, for example, using PCR with primers carrying random sequence spanning the CDR of interest, in selected individual Fv clones and screening for higher affinity clones. WO 9607754 described a method for inducing mutagenesis in a complementarity determining region of an immunoglobulin light chain to create a library of light chain genes. Another effective approach is to recombine the VH or VL domains selected by phage display with repertoires of naturally occurring V domain variants obtained from unimmunized donors and screen for higher affinity in several rounds of chain reshuffling as described in Marks et al., Biotechnol., 10: 779-783 (1992). This technique allows the production of antibodies and antibody fragments with affinities in the $10^{-9}$ M range.

The phage library samples are contacted with an immobilized protein under conditions suitable for binding of at least a portion of the phage particles with the adsorbent. Normally, the conditions, including pH, ionic strength, temperature and the like are selected to mimic physiological conditions. The phages bound to the solid phase are washed and then eluted by acid, e.g., as described in Barbas et al., Proc. Natl. Acad. Sci. USA, 88: 7978-7982 (1991), or by alkali, (e.g., as described in Marks et al., J. Mol. Biol., 222: 581-597 (1991)), or by antigen competition, (e.g., in a procedure similar to the antigen competition method of Clackson et al., Nature, 352: 624-628 (1991)). Phages may be enriched 20-1,000-fold in a single round of selection. Moreover, the enriched phages may be grown in bacterial culture and subjected to further rounds of selection.

The efficiency of selection depends on many factors, including the kinetics of dissociation during washing, and whether multiple antibody fragments on a single phage can simultaneously engage with antigen. Antibodies with fast dissociation kinetics (and weak binding affinities) may be retained by use of short washes, multivalent phage display and high coating density of antigen in solid phase. The high density not only stabilizes the phage through multivalent interactions, but favors rebinding of phage that has dissociated. The selection of antibodies with slow dissociation kinetics (and good binding affinities) may be promoted by use of long washes and monovalent phage display as described in Bass et al., Proteins, 8: 309-314 (1990) and in WO 92/09690, and a low coating density of antigen as described in Marks et al., Biotechnol., 10: 779-783 (1992).

DNA encoding the hybridoma-derived monoclonal antibodies or phage display Fv clones disclosed herein is readily isolated and sequenced using conventional procedures (e.g., by using oligonucleotide primers designed to specifically amplify the heavy and light chain coding regions of interest from hybridoma or phage DNA template). Once isolated, the DNA can be placed into expression vectors, which are then transfected into host cells such as E. coli cells, simian COS cells, Chinese hamster ovary (CHO) cells, or myeloma cells that do not otherwise produce immunoglobulin protein, to obtain the synthesis of the desired monoclonal antibodies in the recombinant host cells. Recombinant expression in bacteria of antibody-encoding DNA has been described by Better et al., U.S. Pat. No. 6,204,023 (see also, e.g., Skerra et al., Curr. Opinion in Immunol., 5: 256 (1993) and Pluckthun, Immunol. Revs, 130: 151 (1992)).

DNA encoding Fv clones as disclosed herein may be combined with known DNA sequences encoding heavy chain and/or light chain constant regions (e.g., the appropriate DNA sequences can be obtained from Kabat et al., supra) to form clones encoding full or partial length heavy and/or light chains. It will be appreciated that constant regions of any isotype can be used for this purpose, including IgG, IgM, IgA, IgD, and IgE constant regions, and that such constant regions may be obtained from any human or animal species. A Fv clone derived from the variable domain DNA of one animal (such as human) species and then fused to constant region DNA of another animal species to form coding sequence(s) for "hybrid", full length heavy chain and/or light chain is included in the definition of "chimeric" and "hybrid" antibody as used herein. In a preferred Fv clone embodiment, aFv clone derived from human variable DNA is fused to human constant region DNA to form coding sequence(s) for all human, full or partial length heavy and/or light chains.

DNA encoding a humanized antibody comprising an ultralong CDR3 derived from a hybridoma disclosed herein may also be modified, for example, by substituting the coding sequence for human heavy- and light-chain constant domains in place of homologous murine sequences derived from the hybridoma clone (e.g., as in the method of Morrison et al., Proc. Natl. Acad. Sci. USA, 81: 6851-6855 (1984)). DNA encoding a hybridoma or Fv clone-derived antibody or fragment can be further modified by covalently joining to the immunoglobulin coding sequence all or part of the coding sequence for a non-immunoglobulin polypeptide. In this manner, "chimeric" or "hybrid" antibodies are prepared that have the binding specificity of the Fv clone or hybridoma clone-derived antibodies disclosed herein.

Antibody Genes and Proteins

The present disclosure provides antibody genes and proteins including, for example, humanized antibody genes or proteins that comprise an ultralong CDR3 sequence and/or a CDR3 scaffold. The present disclosure additionally provides VH, DH, and JH sequences useful in the preparation of ultralong CDR3 sequences. Such sequences may comprise motifs (e.g., cysteine motifs) as described herein including those as described in the many embodiments disclosed herein. In some embodiments, the antibodies disclosed herein may selectively or specifically bind to an epitope of a target protein. In some embodiments, the antibody may be an antagonist (e.g., blocking) antibody or an agonist antibody.

The variable region of the heavy and light chains are encoded by multiple germline gene segments separated by non-coding regions, or introns, and often are present on different chromosomes. For example, the genes for the human immunoglobulin heavy chain region contains approximately 65 variable (VH) genes, 27 Diversity (DH) genes, and 6 Joining (JH) genes. The human kappa ($\kappa$) and lambda ($\lambda$) light chains are also each encoded by a similar number of VL and JL gene segments, but do not include any D gene segments. Exemplary VH, DH, JH and VL (V$\kappa$ or V$\lambda$) and JL (J$\kappa$ or J$\lambda$) germline gene segments are set forth in WO 2010/054007.

During B cell differentiation germline DNA is rearranged whereby one DH and one JH gene segment of the heavy chain locus are recombined, which is followed by the joining of one VH gene segment forming a rearranged VDJ gene that encodes a VH chain. The rearrangement occurs only on a single heavy chain allele by the process of allelic exclusion. Allelic exclusion is regulated by in-frame or "productive" recombination of the VDJ segments, which occurs in only about one-third of VDJ recombinations of the variable heavy chain. When such productive recombination events first occur in a cell, this result in production of a $\mu$ heavy chain that gets expressed on the surface of a pre-B cell and transmits a signal to shut off further heavy chain recombination, thereby preventing expression of the allelic heavy chain locus. The surface-expressed $\mu$ heavy chain also acts to activate the kappa ($\kappa$) locus for rearrangement. The lambda ($\lambda$) locus is only activated for rearrangement if the $\kappa$ recombination is unproductive on both loci. The light chain rearrangement events are similar to the heavy chain, except that only the VL and JL segments are recombined. Before primary transcription of each, the corresponding constant chain gene is added. Subsequent transcription and RNA splicing leads to mRNA that is translated into an intact light chain or heavy chain.

The variable regions of antibodies confer antigen binding and specificity due to recombination events of individual germline V, D and J segments, whereby the resulting recombined nucleic acid sequences encoding the variable region domains differ among antibodies and confer antigen-specificity to a particular antibody. The variation, however, is limited to three complementarity determining regions (CDR1, CDR2, and CDR3) found within the N-terminal domain of the heavy (H) and (L) chain variable regions. The CDRs are interspersed with regions that are more conserved, termed "framework regions" (FR). The extent of the framework region and CDRs has been precisely defined (see e.g., Kabat, E. A. et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917). Each VH and VL is typically composed of three CDRs and four FRs arranged from the amino terminus to carboxy terminus in the following order: FR1, CDR1, FR2, CDR2, FR3, CDR3 and FR4. Sequence variability among VL and VH domains is generally limited to the CDRs, which are the regions that form the antigen binding site. For example, for the heavy chain, generally, VH genes encode the N-terminal three framework regions, the first two complete CDRs and the first part of the third CDR), the DH gene encodes the central portion of the third CDR, and the JH gene encodes the last part of the third CDR and the fourth framework region. For the light chain, the VL genes encode the first CDR and second CDR. The third CDR (CDRL3) is formed by the joining of the VL and JL gene segments. Hence, CDRs 1 and 2 are exclusively encoded by germline V gene segment sequences. The VH and VL chain CDR3s form the center of the Ag-binding site, with CDRs 1 and 2 form the outside boundaries; the FRs support the scaffold by orienting the H and L CDRs. On average, an antigen binding site typically requires at least four of the CDRs make contact with the antigen's epitope, with CDR3 of both the heavy and light chain being the most variable and contributing the most specificity to antigen binding (see, e.g., Janis Kuby, Immunology, Third Edition, New York, W.H. Freeman and Company, 1998, pp. 115-118). CDRH3, which includes all of the D gene segment, is the most diverse component of the Ab-binding site, and typically plays a critical role in defining the specificity of the Ab. In addition to sequence variation, there is variation in the length of the CDRs between the heavy and light chains.

The constant regions, on the other hand, are encoded by sequences that are more conserved among antibodies. These domains confer functional properties to antibodies, for example, the ability to interact with cells of the immune system and serum proteins in order to cause clearance of infectious agents. Different classes of antibodies, for example IgM, IgD, IgG, IgE and IgA, have different constant regions, allowing them to serve distinct effector functions.

These natural recombination events of V, D, and J, can provide nearly $2 \times 10^7$ different antibodies with both high affinity and specificity. Additional diversity is introduced by nucleotide insertions and deletions in the joining segments and also by somatic hypermutation of V regions. The result is that there are approximately $10^{10}$ antibodies present in an individual with differing antigen specificities.

Antibodies include bovine antibody BLVH12 (e.g., heavy chain variable region set forth in SEQ ID NO: 482, and light chain variable region set forth in SEQ ID NO: 483); and bovine antibody BLV5B8 (e.g., heavy chain variable region set forth in SEQ ID NO: 484, and light chain variable region set forth in SEQ ID NO: 485)

Antibody Fragments

The present disclosure encompasses antibody fragments. In certain circumstances there are advantages of using antibody fragments, rather than whole antibodies. The smaller size of the fragments allows for rapid clearance, and may lead to improved access to solid tumors. Antibody fragments include, but are not limited to, Fab, Fab', Fab'-SH, F(ab')2, Fv, and scFv fragments, and other fragments described below. For a review of certain antibody fragments, see Hudson et al. Nat. Med. 9:129-134 (2003). For a review of scFv fragments, see, e.g., Pluckthun, in The Pharmacology of Monoclonal Antibodies, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869,046.

Diabodies are antibody fragments with two antigen binding sites that may be bivalent or bispecific. See, for example, EP 404,097; WO 1993/01161; Hudson et al., Nat. Med. 9:129-134 (2003); and Hollinger et al., Proc. Natl. Acad. Sci. USA 90: 6444-6448 (1993). Triabodies and tetrabodies are also described in Hudson et al., Nat. Med. 9: 129134 (2003).

Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, Mass.; see, e.g., U.S. Pat. No. 6,248,516). Antibody fragments can be made by various techniques, including but not limited to proteolytic digestion of an intact antibody as well as production by recombinant host cells (e.g. *E. coli* or phage), as described herein.

Various techniques have been developed for the production of antibody fragments. Traditionally, these fragments were derived via proteolytic digestion of intact antibodies (see, e.g., Morimoto et al., Journal of Biochemical and Biophysical Methods 24:107-117 (1992); and Brennan et al., Science, 229:81 (1985)). However, these fragments can now be produced directly by recombinant host cells. Fab, Fv and ScFv antibody fragments can all be expressed in and secreted from *E. coli*, thus allowing the facile production of large amounts of these fragments (see, e.g., U.S. Pat. No. 6,204,023). Antibody fragments can be isolated from antibody phage libraries as discussed above. Alternatively, Fab'-SH fragments can be directly recovered from *E. coli* and chemically coupled to form $F(ab')_2$ fragments (see, e.g., Carter et al., Bio/Technology 10: 163-167 (1992)). According to another approach, $F(ab')_2$ fragments can be isolated directly from recombinant host cell culture. Fab and $F(ab')_2$ fragment with increased in vivo half-life comprising a salvage receptor binding epitope residues (see, e.g., in U.S. Pat. No. 5,869,046). Other techniques for the production of antibody fragments will be apparent to the skilled practitioner. In other embodiments, the antibody of choice is a single chain Fv fragment (scFv or single chain antibody (SCA)). See WO 93/16185; U.S. Pat. Nos. 5,571,894; and 5,587,458. Fv and sFv are the only species with intact combining sites that are devoid of constant regions; thus, they are suitable for reduced nonspecific binding during in vivo use. sFv fusion proteins may be constructed to yield fusion of an effector protein at either the amino or the carboxy terminus of an sFv. See Antibody Engineering, ed. Borrebaeck, Supra. The antibody fragment may also be a "linear antibody", for example, as described in U.S. Pat. No. 5,641,870. Such linear antibody fragments may be monospecific or bispecific.

Humanized Antibodies

The present disclosure provides humanized antibodies comprising an ultralong CDR3. Humanized antibodies may include human engineered antibodies (see, e.g., Studnicka et al. (1994) Protein Eng. 7(6) 805-814; and U.S. Pat. No.

5,766,886). Various methods for humanizing non-human antibodies are known in the art. For example, a humanized antibody can have one or more amino acid residues introduced into it from a source which is human or non-human. Humanization may be performed following the method of Studnicka (see, e.g., Studnicka et al. (1994) Protein Eng. 7(6) 805-814; and U.S. Pat. No. 5,766,886), including the preparation of modified antibody variable domains. Humanization may alternatively be performed following the method of Winter and co-workers (Jones et al. (1986) Nature 321:522-525; Riechmann et al. (1988) Nature 332:323-327; Verhoeyen et al. (1988) Science 239:1534-1536), by substituting hypervariable region sequences for the corresponding sequences of a human antibody. Accordingly, such "humanized" or "human engineered" antibodies are chimeric antibodies, including wherein substantially less than an intact human variable domain has been substituted by or incorporated into the corresponding sequence from a non-human species. For example, humanized antibodies may be human antibodies in which some hypervariable region residues and possibly some FR residues are substituted by residues from analogous sites in rodent antibodies. Alternatively, humanized or human engineered antibodies may be non-human (e.g, rodent) antibodies in which some residues are substituted by residues from analogious sites in human antibodies (see, e.g., Studnicka et al. (1994) Protein Eng. 7(6) 805-814; and U.S. Pat. No. 5,766,886).

The choice of human variable domains, both light and heavy, to be used in making the humanized antibodies is important to reduce antigenicity. For example, to the so-called "best-fit" method, the sequence of the variable domain of a rodent antibody is screened against the entire library of known human variable-domain sequences. The human sequence which is closest to that of the rodent is then accepted as the human framework for the humanized antibody (Sims et al. (1993) J. Immunol. 151:2296; Chothia et al. (1987) J. Mol. Biol. 196:901). Another method uses a particular framework derived from the consensus sequence of all human antibodies of a particular subgroup of light or heavy chains. The same framework may be used for several different humanized antibodies (Carter et al. (1992) Proc. Natl. Acad. Sci. USA, 89:4285; Presta et al. (1993) J. Immunol., 151:2623).

It is further important that antibodies be humanized with retention of high affinity for the antigen and other favorable biological properties. To achieve this goal, according to one method, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the hypervariable region residues are directly and most substantially involved in influencing antigen binding.

In some embodiments, the humanized antibodies comprising an ultralong CDR3 may be deimmunized. Methods of deimmunizing an antibody or protein are well known in the art. The immunogenicity of therapeutic proteins such as antibodies is thought to result from the presence of T-cell epitopes which can bind MHC class II molecules and generate a proliferative and cytokine response in CD4+ helper T-cells. These CD4+ helper cells then collaborate with B-cells to generate an antibody response against the therapeutic protein. Removal of the T-cell epitopes are thought to be key steps in deimmunizing a recombinant protein. T-cell epitopes can be predicted by in silico algorithms that identify residues required for binding MHC. Alternatively, epitopes can be identified directly by utilizing peripheral blood mononuclear cells from panels of human donors and measuring their response against the therapeutic protein when incubated with antigen presenting cells. Such in silico and in vitro systems are well known in the art [Jones T D, Crompton L J, Carr F J, Baker M P. Methods Mol Biol. 2009; 525:405-23, Deimmunization of monoclonal antibodies; and Baker M, and Jones T D. The identification and removal of immunogenicity in therapeutic proteins. *Curr. Opin. Drug Discovery Dev.* 2007; (2007); 10(2): 219-227]. When peptides are identified that bind MHC II or otherwise stimulate CD4+ cell activation, the residues of the peptide can be mutated one by one and tested for T-cell activation until a mutation is found which disrupts MHC II binding and T-cell activation. Such mutations, when found in an individual peptide, can be encoded directly in the recombinant therapeutic protein. Incubation of the whole protein with antigen presenting cells will not induce a significant CD4+ response, indicating successful deimmunization.

Bispecific Antibodies

Bispecific antibodies are monoclonal, preferably human or humanized, antibodies that have binding specificities for at least two different antigens. For example, one of the binding specificities may be for a first antigen and the other may be for any other antigen.

Exemplary bispecific antibodies may bind to two different epitopes of the same protein. Bispecific antibodies may also be used to localize cytotoxic agents to cells which express a particular protein. These antibodies possess a binding arm specific for the particular protein and an arm which binds the cytotoxic agent (e.g., saporin, anti-interferon-a, *vinca* alkaloid, ricin A chain, methotrexate or radioactive isotope hapten). Bispecific antibodies may be prepared as full length antibodies or antibody fragments (e.g., F(ab')$_2$ bispecific antibodies).

Methods for making bispecific antibodies are known in the art. Traditionally, the recombinant production of bispecific antibodies is based on the co-expression of two immunoglobulin heavy chain-light chain pairs, where the two heavy chains have different specificities (Milstein and Cuello, Nature, 305: 537 (1983)). Because of the random assortment of immunoglobulin heavy and light chains, these hybridomas (quadromas) produce a potential mixture of 10 different antibody molecules, of which only one has the correct bispecific structure. The purification of the correct molecule, which is usually done by affinity chromatography steps, is rather cumbersome, and the product yields are low. Similar procedures are disclosed in WO 93/08829, and in Traunecker et al., EMBO J., 10: 3655 (1991).

According to a different approach, antibody variable domains with the desired binding specificities (antibody-antigen combining sites) are fused to immunoglobulin constant domain sequences. The fusion preferably is with an immunoglobulin heavy chain constant domain, comprising at least part of the hinge, CH2, and CH3 regions. It is preferred to have the first heavy-chain constant region (CH1), containing the site necessary for light chain binding, present in at least one of the fusions. DNAs encoding the immunoglobulin heavy chain fusions and, if desired, the immunoglobulin light chain, are inserted into separate expression vectors, and are co-transfected into a suitable host organism. This provides for flexibility in adjusting the mutual proportions of the three polypeptide fragments in embodiments when unequal ratios of the three polypeptide chains used in the construction provide the optimum yields. It is, however, possible to insert the coding sequences for two or all three polypeptide chains in one expression vector when the expression of at least two polypeptide chains in equal ratios results in high yields or when the ratios are not of particular significance.

In a preferred embodiment of this approach, the bispecific antibodies are composed of a hybrid immunoglobulin heavy chain with a first binding specificity in one arm, and a hybrid immunoglobulin heavy chain-light chain pair (providing a second binding specificity) in the other arm. This asymmetric structure may facilitate the separation of the desired bispecific compound from unwanted immunoglobulin chain combinations, as the presence of an immunoglobulin light chain in only one half of the bispecific molecule provides for a facile way of separation. This approach is disclosed in WO 94/04690. For further details of generating bispecific antibodies see, for example, Suresh et al., Methods in Enzymology, 121:210 (1986).

According to another approach, the interface between a pair of antibody molecules may can be engineered to maximize the percentage of heterodimers which are recovered from recombinant cell culture. The preferred interface comprises at least a part of the CH3 domain of an antibody constant domain. In this method, one or more small amino acid side chains from the interface of the first antibody molecule are replaced with larger side chains (e.g., tyrosine or tryptophan). Compensatory "cavities" of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers.

Bispecific antibodies include cross-linked or "heteroconjugate" antibodies. For example, one of the antibodies in the heteroconjugate may be coupled to avidin, the other to biotin. Such antibodies have, for example, been proposed to target immune system cells to unwanted cells (U.S. Pat. No. 4,676,980), and for treatment of HIV infection (WO 91/00360, WO 92/00373, and EP 03089). Heteroconjugate antibodies may be made using any convenient cross-linking methods. Suitable cross-linking agents are well known in the art, and are disclosed in U.S. Pat. No. 4,676,980, along with a number of cross-linking techniques.

Techniques for generating bispecific antibodies from antibody fragments have also been described in the literature. For example, bispecific antibodies may be prepared using chemical linkage. Brennan et al., Science, 229: 81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced may be used as agents for the selective immobilization of enzymes.

Recent progress has facilitated the direct recovery of Fab'-SH fragments from E. coli, which can be chemically coupled to form bispecific antibodies. Shalaby et al., J. Exp. Med., 175: 217-225 (1992) describe the production of a fully humanized bispecific antibody F(ab')$_2$ molecule. Each Fab' fragment was separately secreted from E. coli and subjected to directed chemical coupling in vitro to form the bispecific antibody. The bispecific antibody thus formed was able to bind to cells overexpressing the HER2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. See, e.g., Kostelny et al., J. Immunol., 148(5): 1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA, 90:6444-6448 (1993) has provided an alternative mechanism for making bispecific antibody fragments. The fragments comprise a heavy-chain variable domain (VH) connected to a light-chain variable domain (VL) by a linker which is too short to allow pairing between the two domains on the same chain. Accordingly, the VH and VL domains of one fragment are forced to pair with the complementary VL and VH domains of another fragment, thereby forming two antigen-binding sites. Another strategy for making bispecific antibody fragments by the use of single-chain Fv (sFv) dimers has also been reported. See, Gruber et al., J. Immunol., 152:5368 (1994).

Antibodies with more than two valencies are contemplated. For example, trispecific antibodies can be prepared. See, e.g., Tutt et al. J. Immunol. 147: 60 (1991).

Multivalent Antibodies

A multivalent antibody may be internalized (and/or catabolized) faster than a bivalent antibody by a cell expressing an antigen to which the antibodies bind. The antibodies of the present disclosure may be multivalent antibodies (which are other than of the IgM class) with three or more antigen binding sites (e.g., tetravalent antibodies), which may be produced by recombinant expression of nucleic acid encoding the polypeptide chains of the antibody. The multivalent antibody may comprise a dimerization domain and three or more antigen binding sites. A preferred dimerization domain may comprise (or consist of) an Fc region or a hinge region. In this scenario, the antibody will comprise an Fc region and three or more antigen binding sites amino-terminal to the Fe region. A preferred multivalent antibody may comprise (or consist of) three to about eight, but preferably four, antigen binding sites. The multivalent antibody comprises at least one polypeptide chain (and preferably two polypeptide chains), wherein the polypeptide chain(s) comprise two or more variable domains. For instance, the polypeptide chain(s) may comprise VD1-(X1)n-VD2-(X2)n-Fc, wherein VD1 is a first variable domain, VD2 is a second variable domain, Fc is one polypeptide chain of an Fc region, X1 and X2 represent an amino acid or polypeptide, and n is 0 or 1. For instance, the polypeptide chain(s) may comprise: VH-CH1-flexible linker-VH-CH1-Fc region chain; or VH-CH1-VH-CH1-Fc region chain. A multivalent antibody may preferably further comprises at least two (and preferably four) light chain variable domain polypeptides. A multivalent antibody may, for instance, comprise from about two to about eight light chain variable domain polypeptides. The light chain variable domain polypeptides may comprise a light chain variable domain and, optionally, further comprise a CL domain.

Antibody Variants

In some embodiments, amino acid sequence modification(s) of the humanized antibodies comprising an ultralong CDR3 as described herein are contemplated. For example, it may be desirable to improve the binding affinity and/or other biological properties of the antibody. Amino acid sequence variants of the antibody are prepared by introducing appropriate nucleotide changes into the antibody nucleic acid, or by peptide synthesis. Such modifications include, for example, deletions from, and/or insertions into and/or substitutions of, residues within the amino acid sequences of the antibody. Any combination of deletion, insertion, and substitution is made to arrive at the final construct, provided that the final construct possesses the desired characteristics. The amino acid alterations may be introduced in the subject antibody amino acid sequence at the time that sequence is made.

A useful method for identification of certain residues or regions of the antibody that are preferred locations for mutagenesis is called "alanine scanning mutagenesis" as described by Cunningham and Wells (1989) Science, 244: 1081-1085. Here, a residue or group of target residues are identified (e.g., charged residues such as arg, asp, his, lys, and glu) and replaced by a neutral or negatively charged amino acid (most preferably alanine or polyalanine) to affect the interaction of the amino acids with antigen. Those amino acid locations demonstrating functional sensitivity to the substitutions then are refined by introducing further or other variants at, or for, the sites of substitution. Thus, while the site for introducing an amino acid sequence variation is predetermined, the nature of the mutation per se need not be predetermined. For example, to analyze the performance of a mutation at a given site, ala scanning or random mutagenesis is conducted at the target codon or region and the expressed immunoglobulins are screened for the desired activity.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue or the antibody fused to a cytotoxic polypeptide. Other insertional variants of the antibody molecule include the fusion to the N- or C-terminus of the antibody to an enzyme (e.g., for ADEPT) or a polypeptide which increases the serum half-life of the antibody.

Glycosylation of polypeptides is typically either N-linked or O-linked. N-linked refers to the attachment of the carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-aceylgalactosamine, galactose, or xylose to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original antibody (for O-linked glycosylation sites).

Where the antibody comprises an Fc region, the carbohydrate attached thereto may be altered. For example, antibodies with a mature carbohydrate structure that lacks fucose attached to an Fc region of the antibody have been described (see, e.g., US 2003/0157108, US 2004/0093621. Antibodies with a bisecting N-acetylglucosamine (GlcNAc) in the carbohydrate attached to an Fc region of the antibody have been described (see, e.g., WO 2003/011878, and U.S. Pat. No. 6,602,684). Antibodies with at least one galactose residue in the oligosaccharide attached to an Fc region of the antibody WO 1997/30087; see, also, WO 1998/58964 and WO 1999/22764 concerning antibodies with altered carbohydrate attached to the Fc region thereof). Antigen-binding molecules with modified glycosylation have been described (see, e.g., WO 99/54342, U.S. Pat. Nos. 6,602,684 and 7,517,670, and US 2004/0072290; see also, e.g., U.S. Pat. Nos. 7,214,775 and 7,682,610).

The preferred glycosylation variant herein comprises an Fc region, wherein a carbohydrate structure attached to the Fc region lacks fucose. Such variants have improved ADCC function. Optionally, the Fc region further comprises one or more amino acid substitutions therein which further improve ADCC, for example, substitutions at positions 298, 333, and/or 334 of the Fc region (Eu numbering of residues). Examples of publications related to "defucosylated" or "fucose-deficient" antibodies include: US 2003/0157108; WO 2000/61739; WO 2001/29246; US 2003/0115614 (now U.S. Pat. No. 6,946,292) US 2002/0164328 (now U.S. Pat. No. 7,064,191); US 2004/0093621; US 2004/0132140; US 2004/0110704; US 2004/0110282 (now U.S. Pat. No. 7,749, 753); US 2004/0109865; WO 2003/085119; WO 2003/084570; WO 2005/035586; WO 2005/035778; WO2005/053742; Okazaki et al. J. Mol. Biol. 336:1239-1249 (2004); Yamane-Ohnuki et al. Biotech. Bioeng. 87: 614 (2004). Examples of cell lines producing defucosylated antibodies include Lec13 CHO cells deficient in protein fucosylation (Ripka et al. Arch. Biochem. Biophys. 249:533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, FUT8, knockout CHO cells (Yamane-Ohnuki et al. Biotech. Bioeng. 87: 614 (2004)).

Another type of variant is an amino acid substitution variant. These variants have at least one amino acid residue in the antibody molecule replaced by a different residue. The sites of greatest interest for substitutional mutagenesis include the hypervariable regions, but FR alterations are also contemplated. Conservative substitutions are shown in Table 2 under the heading of "preferred substitutions". If such substitutions result in a change in biological activity, then more substantial changes, denominated "exemplary substitutions", or as further described below in reference to amino acid classes, may be introduced and the products screened.

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: Cys, Ser, Thr, Asn, Gln; (3) acidic: asp, glu; (4) basic: his, lys, arg; (5) residues that influence chain orientation: gly, pro; and (6) aromatic: trp, tyr, phe.

Non-conservative substitutions will entail exchanging a member of one of these classes for another class.

One type of substitutional variant involves substituting one or more hypervariable region residues of a parent antibody (e.g., a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e.g., 6-7 sites) are mutated to generate all possible amino acid substitutions at each site. The antibodies thus generated are displayed from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the antibody and antigen. Such contact residues and neighboring residues are candidates for substitution according to the techniques elaborated herein. Once such variants are generated, the panel of variants is subjected to screening as described herein and antibodies with superior properties in one or more relevant assays may be selected for further development.

Nucleic acid molecules encoding amino acid sequence variants of the antibody are prepared by a variety of methods known in the art. These methods include, but are not limited to, isolation from a natural source (in the case of naturally occurring amino acid sequence variants) or preparation by oligonucleotide-mediated (or site-directed) mutagenesis, PCR mutagenesis, and cassette mutagenesis of an earlier prepared variant or a non-variant version of the antibody.

It may be desirable to introduce one or more amino acid modifications in an Fc region of the immunoglobulin polypeptides disclosed herein, thereby generating a Fc region variant. The Fc region variant may comprise a human Fc region sequence (e.g., a human IgG1, IgG2, IgG3 or IgG4 Fc region) comprising an amino acid modification (e.g., a substitution) at one or more amino acid positions including that of a hinge cysteine.

In accordance with this description and the teachings of the art, it is contemplated that in some embodiments, an antibody used in methods disclosed herein may comprise one or more alterations as compared to the wild type counterpart antibody, e.g., in the Fc region. These antibodies would nonetheless retain substantially the same characteristics required for therapeutic utility as compared to their wild type counterpart. For example, it is thought that certain alterations can be made in the Fc region that would result in altered (e.g., either improved or diminished) C1q binding and/or Complement Dependent Cytotoxicity (CDC), e.g., as described in WO99/51642. See also Duncan & Winter Nature 322:738-40 (1988); U.S. Pat. Nos. 5,648,260; 5,624,821; and WO94/29351 concerning other examples of Fc region variants. WO00/42072 and WO 2004/056312 describe antibody variants with improved or diminished binding to FcRs. See, also, Shields et al. J. Biol. Chem. 9(2): 6591-6604 (2001). Antibodies with increased half lives and improved binding to the neonatal Fc receptor (FcRn), which is responsible for the transfer of maternal IgGs to the fetus (Guyer et al., J. Immunol. 117:587 (1976) and Kim et al., J. Immunol. 24:249 (1994)), are described in US2005/0014934 (Hinton et al.). These antibodies comprise an Fc reg on with one or more substitutions therein which improve binding of the Fc region to FcRn. Polypeptide variants with altered Fc region amino acid sequences and increased or decreased C1q binding capability are described in U.S. Pat. No. 6,194,551, WO99/51642. See, also, Idusogie et al. J. Immunol. 164:4178-4184 (2000).

In certain embodiments, the present disclosure contemplates an antibody variant that possesses some but not all effector functions, which make it a desirable candidate for applications in which the half life of the antibody in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, Annu. Rev. Immunol. 9:457-492 (1991). Non-limiting examples of in vitro assays to assess ADCC activity of a molecule of interest is described in U.S. Pat. No. 5,500,362 (see, e.g. Hellstrom, I. et al. Proc. Nat'l Acad. Sci. USA 83:7059-7063 (1986)) and Hellstrom, I et al., Proc. Nat'l Acad. Sci. USA 82:1499-1502 (1985); 5,821,337 (see, Bruggemann, M. et al., Exp. Med. 166:1351-1361 (1987)). Alternatively, non-radioactive assays methods may be employed (see, for example, ACTI™ non-radioactive cytotoxicity assay for flow cytometry (CellTecllrlology, Inc. Mountain View, Calif.; and CytoTox 96® non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al. Proc. Nat'l Acad. Sci. USA 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., Immunol. Methods 202:163 (1996); Cragg, M. S. et al., Blood 101: 1045-1052 (2003); and Cragg, M. S, and M. J. Glennie, Blood 103:27382743 (2004)). FcRn binding and in vivo clearance/half life determinations can also be performed using methods known in the art (see, e.g., Petkova, S. B. et al., Int'l Immunol. 18(12):1759-1769 (2006)).

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Certain antibody variants with improved or diminished binding to FcRs are described. (See, e.g., U.S. Pat. No. 6,737,056; WO 2004/056312, and Shields et al., Biol. Chem. 9(2): 6591-6604 (2001).)

In certain embodiments, an antibody variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either improved or diminished) C1q binding and/or Complement Dependent Cytotoxicity (CDC), e.g., as described in U.S. Pat. No. 6,194,551, WO 99/51642, and Idusogie et al. Immunol. 164: 41784184 (2000).

Antibodies with increased half lives and improved binding to the neonatal Fc receptor (FcRn), which is responsible for the transfer of maternal IgGs to the fetus (Guyer et al., Immunol. 117:587 (1976) and Kim et al., Immunol. 24:249 (1994)), are described in US2005/0014934A1 (Hinton et al.). Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826).

See also Duncan & Winter, Nature 322:738-40 (1988); U.S. Pat. Nos. 5,648,260; 5,624,821; and WO 94/29351 concerning other examples of Fc region variants.

Antibody Derivatives

The humanized antibodies comprising an ultralong CDR3 as disclosed herein may be further modified to contain additional nonproteinaceous moieties that are known in the art and readily available. Preferably, the moieties suitable for derivatization of the antibody are water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymers are attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

Vectors, Host Cells and Recombinant Methods

For recombinant production of an antibody or fragment thereof as disclosed herein, the nucleic acid encoding it is isolated and inserted into a replicable vector for further cloning (amplification of the DNA) or for expression. DNA encoding the antibody is readily isolated and sequenced using conventional procedures (e.g., by using oligonucleotide probes that are capable of binding specifically to genes encoding the heavy and light chains of the antibody). In an exemplary embodiment, nucleic acid encoding a humanized antibody comprising an ultralong CDR3, a variable region comprising an ultralong CDR3, or an ultralong CDR3, is isolated and inserted into a replicable vector for further cloning (amplification of the DNA) or for expression. Many vectors are available. The choice of vector depends in part on the host cell to be used. Generally, preferred host cells are of either prokaryotic or eukaryotic (generally mammalian) origin. It will be appreciated that constant regions of any isotype can be used for this purpose, including IgG, IgM, IgA, IgD, and IgE constant regions, and that such constant regions can be obtained from any human or animal species.

Expression vectors containing regulatory elements from eukaryotic viruses are typically used in eukaryotic expression vectors, e.g., SV40 vectors, papilloma virus vectors, and vectors derived from Epstein-Barr virus. Other exemplary eukaryotic vectors include pMSG, pAV009/A+, pMTO10/A+, pMAMneo-5, baculovirus pDSVE, and any other vector allowing expression of proteins under the direction of the CMV promoter, SV40 early promoter, SV40 later promoter, metallothionein promoter, murine mammary tumor virus promoter, Rous sarcoma virus promoter, polyhedrin promoter, or other promoters shown effective for expression in eukaryotic cells.

Some expression systems have markers that provide gene amplification such as thymidine kinase and dihydrofolate reductase. Alternatively, high yield expression systems not involving gene amplification are also suitable, such as using a baculovirus vector in insect cells, with a nucleic acid sequence encoding a partially human ultralong CDR3 antibody chain under the direction of the polyhedrin promoter or other strong baculovirus promoters.

a. Generating Antibodies Using Prokaryotic or Eukaryotic Host Cells:

i. Vector Construction

Polynucleotide sequences encoding polypeptide components of the antibodies disclosed herein can be obtained using standard recombinant techniques. Desired polynucleotide sequences may be isolated and sequenced from antibody producing cells such as hybridoma cells. Alternatively, polynucleotides can be synthesized using nucleotide synthesizer or PCR techniques. Once obtained, sequences encoding the polypeptides are inserted into a recombinant vector capable of replicating and expressing heterologous polynucleotides in prokaryotic hosts. Many vectors that are available and known in the art can be used for the purpose of the present disclosure. Selection of an appropriate vector will depend mainly on the size of the nucleic acids to be inserted into the vector and the particular host cell to be transformed with the vector. Each vector contains various components, depending on its function (amplification or expression of heterologous polynucleotide, or both) and its compatibility with the particular host cell in which it resides. The vector components generally include, but are not limited to: an origin of replication, a selection marker gene, a promoter, a ribosome binding site (RBS), a signal sequence, the heterologous nucleic acid insert and a transcription termination sequence. Additionally, V regions comprising an ultralong CDR3 may optionally be fused to a C-region to produce an antibody comprising constant regions.

In general, plasmid vectors containing replicon and control sequences which are derived from species compatible with the host cell are used in connection with these hosts. The vector ordinarily carries a replication site, as well as marking sequences which are capable of providing phenotypic selection in transformed cells. For example, *E. coli* is typically transformed using pBR322, a plasmid derived from an *E. coli* species. pBR322 contains genes encoding ampicillin (Amp) and tetracycline (Tet) resistance and thus provides easy means for identifying transformed cells. pBR322, its derivatives, or other microbial plasmids or bacteriophage may also contain, or be modified to contain, promoters which can be used by the microbial organism for expression of endogenous proteins. Examples of pBR322 derivatives used for expression of particular antibodies have been described (see, e.g., U.S. Pat. No. 5,648,237).

In addition, phage vectors containing replicon and control sequences that are compatible with the host microorganism can be used as transforming vectors in connection with these hosts. For example, bacteriophage such as λGEM™-11 may be utilized in making a recombinant vector which can be used to transform susceptible host cells such as *E. coli* LE392.

The expression vectors disclosed herein may comprise two or more promoter-cistron pairs, encoding each of the polypeptide components. A promoter is an untranslated regulatory sequence located upstream (5') to a cistron that modulates its expression. Prokaryotic promoters typically fall into two classes, inducible and constitutive. Inducible promoter is a promoter that initiates increased levels of transcription of the cistron under its control in response to changes in the culture condition, e.g., the presence or absence of a nutrient or a change in temperature.

A large number of promoters recognized by a variety of potential host cells are well known. The selected promoter can be operably linked to cistron DNA encoding the light or heavy chain by removing the promoter from the source DNA via restriction enzyme digestion and inserting the isolated promoter sequence into the vector disclosed herein. Both the native promoter sequence and many heterologous promoters may be used to direct amplification and/or expression of the target genes. In some embodiments, heterologous promoters are utilized, as they generally permit greater transcription and higher yields of expressed target gene as compared to the native target polypeptide promoter.

Promoters suitable for use with prokaryotic hosts include: an ara B promoter, a PhoA promoter, β-galactamase and lactose promoter systems, a tryptophan (trp) promoter system and hybrid promoters such as the tac or the trc promoter. However, other promoters that are functional in bacteria (such as other known bacterial or phage promoters) are suitable as well. Their nucleotide sequences have been published, thereby enabling a skilled worker operably to ligate them to cistrons encoding the target light and heavy chains (e.g., Siebenlist et al. (1980) Cell 20: 269) using linkers or adaptors to supply any required restriction sites.

Suitable bacterial promoters are well known in the art and fully described in scientific literature such as Sambrook and Russell, supra, and Ausubel et al, supra. Bacterial expression systems for expressing antibody chains of the recombinant catalytic polypeptide are available in, e.g., *E. coli, Bacillus* sp., and *Salmonella* (Palva et al., Gene, 22:229-235 (1983); Mosbach et al., Nature, 302:543-545 (1983)).

In one aspect disclosed herein, each cistron within the recombinant vector comprises a secretion signal sequence component that directs translocation of the expressed polypeptides across a membrane. In general, the signal sequence may be a component of the vector, or it may be a part of the target polypeptide DNA that is inserted into the vector. The signal sequence should be one that is recognized and processed (e.g., cleaved by a signal peptidase) by the host cell. For prokaryotic host cells that do not recognize and process the signal sequences native to the heterologous polypeptides, the signal sequence is substituted by a prokaryotic signal sequence selected, for example PelB, OmpA, alkaline phosphatase, penicillinase, Ipp, or heat-stable enterotoxin II (STII) leaders, LamB, PhoE, and MBP. In one embodiment disclosed herein, the signal sequences used in both cistrons of the expression system are STII signal sequences or variants thereof.

In another aspect, the production of the immunoglobulins according to the disclosure can occur in the cytoplasm of the host cell, and therefore does not require the presence of secretion signal sequences within each cistron. In that regard, immunoglobulin light and heavy chains are expressed, folded and assembled to form functional immunoglobulins within the cytoplasm. Certain host strains (e.g., the *E. coli* trxB-strains) provide cytoplasm conditions that are favorable for disulfide bond formation, thereby permitting proper folding and assembly of expressed protein subunits (see e.g., Proba and Pluckthun Gene, 159:203 (1995)).

Suitable host cells for cloning or expression of antibody-encoding vectors include prokaryotic or eukaryotic cells described herein. In one embodiment, the host cell is eukaryotic, e.g. a Chinese Hamster Ovary (CHO) cell, Human Embryonic Kidney (HEK) cell or lymphoid cell (e.g., YO, NS0, Sp20 cell). For example, antibodies may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also Charlton, Methods in Molecular Biology, Vol. 248 (B. K. C. Lo, ed., Humana Press, Totowa, N.J., 2003), pp. 245-254, describing expression of antibody fragments in *E. coli*.) After expression, the antibody may be isolated from the bacterial cell paste in a soluble fraction and can be further purified. In addition to prokaryotes, eukaryotic microbes such as filamentous fungi or yeast are suitable cloning or expression hosts for antibody-encoding vectors, including fungi and yeast strains whose glycosylation pathways have been "humanized," resulting in the production of an antibody with a partially or fully human glycosylation pattern. See Gemgross, Nat. Biotech. 22: 1409-1414 (2004), and Li et al., Nat. Biotech. 24:210-215 (2006). Suitable host cells for the expression of glycosylated antibody are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells. These examples are illustrative rather than limiting. Methods for constructing derivatives of any of the above-mentioned bacteria having defined genotypes are known in the art and described in, for example, Bass et al., Proteins, 8:309-314 (1990). It is generally necessary to select the appropriate bacteria taking into consideration replicability of the replicon in the cells of a bacterium. For example, *E. coli, Serratia*, or *Salmonella* species can be suitably used as the host when well known plasmids such as pBR322, pBR325, pACYC177, or pKN410 are used to supply the replicon. Typically the host cell should secrete minimal amounts of proteolytic enzymes, and additional protease inhibitors may desirably be incorporated in the cell culture.

Plant cell cultures can also be utilized as hosts. See, e.g. U.S. Pat. Nos. 5,959,177, 6,040,498, 6,420,548, 7,125,978, and 6,417,429 (describing PLANTIBODIES™ technology for producing antibodies in transgenic plants). Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., Gen VII '01. 36:59 (1977)); baby hamster kidney cells (BHK); mouse sertoli cells (TM4 cells as described, e.g., in Mather, Biol. Reprod. 23:243-251 (1980)); monkey kidney cells (CV1); African green monkey kidney cells (V ERO-76); human cervical carcinoma cells (HELA); canine kidney cells (MDCK; buffalo rat liver cells (BRL 3A); human lung cells (W138); human liver cells (Hep G2); mouse mammary tumor (MMT 060562); TR1 cells, as described, e.g., in Mather et al., Annals NI'. Acad. Sci. 383:44-68 (1982); MRC 5 cells; and FS4 cells. Other useful mammalian host cell lines include Chinese hamster ovary (CHO) cells, including DHFR' CHO cells (Urlaub et al., Proc. Natl. Acad. Sci. USA 77:4216 (1980)); and myeloma cell lines such as YO, NSO and Sp2/0. For a review of certain mammalian host cell lines suitable for antibody production, see, e.g., Yazaki and Wu, Methods in Molecular Biology, Vol. 248 (B. K. C. Lo, ed., Humana Press, Totowa, N.].), pp. 255-268 (2003).

In one such embodiment, a host cell comprises (e.g., has been transformed with): (1) a vector comprising a nucleic acid that encodes an amino acid sequence comprising the VL of the antibody and an amino acid sequence comprising the VH of the antibody, or (2) a first vector comprising a nucleic acid that encodes an amino acid sequence comprising the VL of the antibody and a second vector comprising a nucleic acid that encodes an amino acid sequence comprising the VH of the antibody.

ii. Antibody Production

For recombinant production of a partially human ultralong CDR3 antibody, nucleic acid encoding a humanized antibody comprising an ultralong CDR3 is inserted into one or more expression vectors for further cloning and/or expression in a host cell. Such nucleic acid may be readily isolated and sequenced using conventional procedures (e.g., by using oligonucleotide probes that are capable of binding specifically to genes encoding the heavy and light chains of the antibody). Host cells are transformed with such expression vectors and cultured in conventional nutrient media modified as appropriate for inducing promoters, selecting transformants, or amplifying the genes encoding the desired sequences.

Transformation means introducing DNA into the prokaryotic host so that the DNA is replicable, either as an extrachromosomal element or by chromosomal integrant. Depending on the host cell used, transformation is done using standard techniques appropriate to such cells. The calcium treatment employing calcium chloride is generally used for bacterial cells that contain substantial cell-wall barriers. Another method for transformation employs polyethylene glycol/DMSO. Yet another technique used is electroporation.

Prokaryotic cells used to produce the polypeptides disclosed herein are grown in media known in the art and suitable for culture of the selected host cells. Examples of suitable media include luria broth (LB) plus necessary nutrient supplements. In some embodiments, the media also contains a selection agent, chosen based on the construction of the expression vector, to selectively permit growth of prokaryotic cells containing the expression vector. For example, ampicillin is added to media for growth of cells expressing ampicillin resistant gene.

Any necessary supplements besides carbon, nitrogen, and inorganic phosphate sources may also be included at appropriate concentrations introduced alone or as a mixture with another supplement or medium such as a complex nitrogen source. Optionally the culture medium may contain one or more reducing agents selected from the group consisting of glutathione, cysteine, cystamine, thioglycollate, dithioerythritol and dithiothreitol.

The prokaryotic host cells are cultured at suitable temperatures. For *E. coli* growth, for example, the preferred temperature ranges from about 20° C. to about 39° C., more preferably from about 25° C. to about 37° C., even more preferably at about 30° C. The pH of the medium may be any pH ranging from about 5 to about 9, depending mainly on the host organism. For *E. coli*, the pH is preferably from about 6.8 to about 7.4, and more preferably about 7.0.

If an inducible promoter is used in the expression vector disclosed herein, protein expression is induced under conditions suitable for the activation of the promoter. For example, an ara B or phoA promoter may be used for controlling transcription of the polypeptides. A variety of inducers may be used, according to the vector construct employed, as is known in the art.

The expressed polypeptides of the present disclosure are secreted into and recovered from the periplasm of the host cells or transported into the culture media. Protein recovery from the periplasm typically involves disrupting the microorganism, generally by such means as osmotic shock, sonication or lysis. Once cells are disrupted, cell debris or whole cells may be removed by centrifugation or filtration. The proteins may be further purified, for example, by affinity resin chromatography. Alternatively, proteins that are transported into the culture media may be isolated therein. Cells may be removed from the culture and the culture supernatant being filtered and concentrated for further purification of the proteins produced. The expressed polypeptides can be further isolated and identified using commonly known methods such as polyacrylamide gel electrophoresis (PAGE) and Western blot assay.

Antibody production may be conducted in large quantity by a fermentation process. Various large-scale fed-batch fermentation procedures are available for production of recombinant proteins. Large-scale fermentations have at least 1000 liters of capacity, preferably about 1,000 to 100,000 liters of capacity. These fermentors use agitator impellers to distribute oxygen and nutrients, especially glucose (a preferred carbon/energy source). Small scale fermentation refers generally to fermentation in a fermentor that is no more than approximately 100 liters in volumetric capacity, and can range from about 1 liter to about 100 liters.

In a fermentation process, induction of protein expression is typically initiated after the cells have been grown under suitable conditions to a desired density, e.g., an OD550 of about 180-220, at which stage the cells are in the early stationary phase. A variety of inducers may be used, according to the vector construct employed, as is known in the art and described above. Cells may be grown for shorter periods prior to induction. Cells are usually induced for about 12-50 hours, although longer or shorter induction time may be used.

To improve the production yield and quality of the polypeptides disclosed herein, various fermentation conditions can be modified. For example, to improve the proper assembly and folding of the secreted antibody polypeptides, additional vectors overexpressing chaperone proteins, such as Dsb proteins (DsbA, DsbB, DsbC, DsbD and or DsbG) or FkpA (a peptidylprolyl cis,trans-isomerase with chaperone activity) may be used to co-transform the host prokaryotic cells. The chaperone proteins have been demonstrated to facilitate the proper folding and solubility of heterologous proteins produced in bacterial host cells. (see e.g., Chen et al. (1999) J Bio Chem 274:19601-19605; U.S. Pat. Nos. 6,083,715; 6,027,888; Bothmann and Pluckthun (2000) J. Biol. Chem. 275:17100-17105; Ramm and Pluckthun (2000) J. Biol. Chem. 275:17106-17113; Arie et al. (2001) Mol. Microbiol. 39:199-210).

To minimize proteolysis of expressed heterologous proteins (especially those that are proteolytically sensitive), certain host strains deficient for proteolytic enzymes can be used for the present disclosure. For example, host cell strains may be modified to effect genetic mutation(s) in the genes encoding known bacterial proteases such as Protease III, OmpT, DegP, Tsp, Protease I, Protease Mi, Protease V, Protease VI and combinations thereof. Some E. coli protease-deficient strains are available (see, e.g., Joly et al. (1998), supra; U.S. Pat. Nos. 5,264,365; 5,508,192; Hara et al., Microbial Drug Resistance, 2:63-72 (1996)).

E. coli strains deficient for proteolytic enzymes and transformed with plasmids overexpressing one or more chaperone proteins may be used as host cells in the expression systems disclosed herein.

iii. Antibody Purification

Standard protein purification methods known in the art can be employed. The following procedures are exemplary of suitable purification procedures: fractionation on immunoaffinity or ion-exchange columns, ethanol precipitation, reverse phase HPLC, chromatography on silica or on a cation-exchange resin such as DEAE, chromatofocusing, SDS-PAGE, ammonium sulfate precipitation, and gel filtration using, for example, Sephadex G-75.

In one aspect, Protein A immobilized on a solid phase is used for immunoaffinity purification of the full length antibody products disclosed herein. Protein A is a 41 kD cell wall protein from *Staphylococcus aureas* which binds with a high affinity to the Fc region of antibodies (see, e.g., Lindmark et al (1983) J. Immunol. Meth. 62:1-13). The solid phase to which Protein A is immobilized is preferably a column comprising a glass or silica surface, more preferably a controlled pore glass column or a silicic acid column. In some applications, the column has been coated with a reagent, such as glycerol, in an attempt to prevent nonspecific adherence of contaminants.

As the first step of purification, the preparation derived from the cell culture as described above is applied onto the Protein A immobilized solid phase to allow specific binding of the antibody of interest to Protein A. The solid phase is then washed to remove contaminants non-specifically bound to the solid phase. Finally the antibody of interest is recovered from the solid phase by elution.

b. Generating Antibodies Using Eukaryotic Host Cells:

The vector components generally include, but are not limited to, one or more of the following: a signal sequence, an origin of replication, one or more marker genes, an enhancer element, a promoter, and a transcription termination sequence.

(i) Signal Sequence Component

A vector for use in a eukaryotic host cell may also contain a signal sequence or other polypeptide having a specific cleavage site at the N-terminus of the mature protein or polypeptide of interest. The heterologous signal sequence selected preferably is one that is recognized and processed (e.g., cleaved by a signal peptidase) by the host cell. In mammalian cell expression, mammalian signal sequences as well as viral secretory leaders, for example, the herpes simplex gD signal, are available.

The DNA for such precursor region is ligated in reading frame to DNA encoding the antibody.

(ii) Origin of Replication

Generally, an origin of replication component is not needed for mammalian expression vectors. For example, the SV40 origin may be used only because it contains the early promoter.

(iii) Selection Gene Component

Expression and cloning vectors may contain a selection gene, also termed a selectable marker. Typical selection genes encode proteins that (a) confer resistance to antibiotics or other toxins, e.g., ampicillin, neomycin, methotrexate, or tetracycline, (b) complement auxotrophic deficiencies, where relevant, or (c) supply critical nutrients not available from complex media.

One example of a selection scheme utilizes a drug to arrest growth of a host cell. Those cells that are successfully transformed with a heterologous gene produce a protein conferring drug resistance and thus survive the selection regimen. Examples of such dominant selection use the drugs neomycin, mycophenolic acid and hygromycin.

Another example of suitable selectable markers for mammalian cells are those that enable the identification of cells competent to take up the antibody nucleic acid, such as DHFR, thymidine kinase, metallothionein-I and -II, preferably primate metallothionein genes, adenosine deaminase, ornithine decarboxylase, etc.

For example, cells transformed with the DHFR selection gene are first identified by culturing all of the transformants in a culture medium that contains methotrexate (Mtx), a competitive antagonist of DHFR. An appropriate host cell when wild-type DHFR is employed is the Chinese hamster ovary (CHO) cell line deficient in DHFR activity (e.g., ATCC CRL-9096).

Alternatively, host cells (particularly wild-type hosts that contain endogenous DHFR) transformed or co-transformed with DNA sequences encoding an antibody, wild-type DHFR protein, and another selectable marker such as aminoglycoside 3'-phosphotransferase (APH) can be selected by cell growth in medium containing a selection agent for the selectable marker such as an aminoglycosidic antibiotic, e.g., kanamycin, neomycin, or G418. See U.S. Pat. No. 4,965,199.

(iv) Promoter Component

Expression and cloning vectors usually contain a promoter that is recognized by the host organism and is operably linked to the antibody polypeptide nucleic acid.

Promoter sequences are known for eukaryotes. Virtually alleukaryotic genes have an AT-rich region located approximately 25 to 30 bases upstream from the site where transcription is initiated. Another sequence found 70 to 80 bases upstream from the start of transcription of many genes is a CNCAAT region where N may be any nucleotide. At the 3' end of most eukaryotic genes is an AATAAA sequence that may be the signal for addition of the poly A tail to the 3' end of the coding sequence. All of these sequences are suitably inserted into eukaryotic expression vectors.

Antibody polypeptide transcription from vectors in mammalian host cells is controlled, for example, by promoters obtained from the genomes of viruses such as polyoma virus, fowlpox virus, adenovirus (such as Adenovirus 2), bovine papilloma virus, avian sarcoma virus, cytomegalovirus, a retrovirus, hepatitis-B virus and Simian Virus 40 (SV40), from heterologous mammalian promoters, e.g., the actin promoter or an immunoglobulin promoter, from heat-shock promoters, provided such promoters are compatible with the host cell systems.

The early and late promoters of the SV40 virus are conveniently obtained as an SV40 restriction fragment that also contains the SV40 viral origin of replication. The immediate early promoter of the human cytomegalovirus is conveniently obtained as a HindIII E restriction fragment. A system for expressing DNA in mammalian hosts using the bovine papilloma virus as a vector is disclosed in U.S. Pat. No. 4,419,446. A modification of this system is described in U.S. Pat. No. 4,601,978. Alternatively, the Rous Sarcoma Virus long terminal repeat can be used as the promoter.

(v) Enhancer Element Component

Transcription of DNA encoding the antibody polypeptide of this disclosure by higher eukaryotes is often increased by inserting an enhancer sequence into the vector. Many enhancer sequences are now known from mammalian genes (globin, elastase, albumin, α-fetoprotein, and insulin). An enhancer from a eukaryotic cell virus may also be used. Examples include the SV40 enhancer on the late side of the replication origin (bp 100-270), the cytomegalovirus early promoter enhancer, the polyoma enhancer on the late side of the replication origin, and adenovirus enhancers. See also Yaniv, Nature 297:17-18 (1982) on enhancing elements for activation of eukaryotic promoters. The enhancer may be spliced into the vector at a position 5' or 3' to the antibody polypeptide-encoding sequence, but is preferably located at a site 5' from the promoter.

(vi) Transcription Termination Component

Expression vectors used in eukaryotic host cells will typically also contain sequences necessary for the termination of transcription and for stabilizing the mRNA. Such sequences are commonly available from the 5' and, occasionally 3', untranslated regions of eukaryotic or viral DNAs or cDNAs. These regions contain nucleotide segments transcribed as polyadenylated fragments in the untranslated portion of the mRNA encoding an antibody. One useful transcription termination component is the bovine growth hormone polyadenylation region. See WO94/11026 and the expression vector disclosed therein.

(vii) Selection and Transformation of Host Cells

Suitable host cells for cloning or expressing the DNA in the vectors herein include higher eukaryote cells described herein, including vertebrate host cells. Propagation of vertebrate cells in culture (tissue culture) has become a routine procedure. Examples of useful mammalian host cell lines are monkey kidney CV 1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77:4216 (1980)); mouse sertoli cells (TM4, Mather, Biol. Reprod. 23:243-251 (1980); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

Any of the well-known procedures for introducing foreign nucleotide sequences into host cells may be used. These include the use of calcium phosphate transfection, polybrene, protoplast fusion, electroporation, biolistics, liposomes, microinjection, plasma vectors, viral vectors and any of the other well known methods for introducing cloned genomic DNA, cDNA, synthetic DNA, or other foreign genetic material into a host cell (see, e.g., Sambrook and Russell, supra). It is only necessary that the particular genetic engineering procedure used be capable of successfully introducing at least both genes into the host cell capable of expressing germline antibody polypeptide.

Host cells are transformed with the above-described expression or cloning vectors for antibody production and cultured in conventional nutrient media modified as appropriate for inducing promoters, selecting transformants, or amplifying the genes encoding the desired sequences.

(viii) Culturing the Host Cells

The host cells used to produce an antibody of this disclosure may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., Meth. Enz. 58:44 (1979), Barnes et al., Anal. Biochem. 102:255 (1980), U.S. Pat. Nos. 4,767,704; 4,657,866; 4,927,762; 4,560,655; or 5,122,469; WO 90/03430; WO 87/00195; or U.S. Pat. Reissue 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

(ix) Purification of Antibody

When using recombinant techniques, the antibody can be produced intracellularly, or directly secreted into the medium. If the antibody is produced intracellularly, as a first step, the particulate debris, either host cells or lysed fragments, are removed, for example, by centrifugation or ultrafiltration. Where the antibody is secreted into the medium, supernatants from such expression systems are generally first concentrated using a commercially available protein concentration filter, for example, an Amicon or Millipore Pellicon® ultrafiltration unit. A protease inhibitor such as PMSF may be included in any of the foregoing steps to inhibit proteolysis and antibiotics may be included to prevent the growth of adventitious contaminants.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human γ1, γ2, or γ4 heavy chains (Lindmark et al., J. Immunol. Meth. 62:1-13 (1983)). Protein G is recommended for all mouse isotypes and for human γ3 (Guss et al., EMBO J. 5:15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a CH3 domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Soluble forms of antibody or fragment present either in the cytoplasm or released from the periplasmic space may be further purified using methods known in the art, for example Fab fragments are released from the bacterial periplasmic space by osmotic shock techniques.

If inclusion bodies comprising an antibody or fragment have formed, they can often bind to the inner and/or outer cellular membranes and thus will be found primarily in the pellet material after centrifugation. The pellet material can then be treated at pH extremes or with chaotropic agent such as a detergent, guanidine, guanidine derivatives, urea, or urea derivatives in the presence of a reducing agent such as dithiothreitol at alkaline pH or tris carboxyethyl phosphine at acid pH to release, break apart, and solubilize the inclusion bodies. The soluble antibody or fragment can then be analyzed using gel electrophoresis, immunoprecipitation or the like. If it is desired to isolate a solublized antibody or antigen binding fragment isolation may be accomplished using standard methods such as those set forth below and in Marston et al. (Meth. Enz., 182:264-275 (1990)).

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25 M salt).

In some cases, an antibody or fragment may not be biologically active upon isolation. Various methods for "refolding" or converting a polypeptide to its tertiary structure and generating disulfide linkages, can be used to restore biological activity. Such methods include exposing the solubilized polypeptide to a pH usually above 7 and in the presence of a particular concentration of a chaotrope. The selection of chaotrope is very similar to the choices used for inclusion body solubilization, but usually the chaotrope is used at a lower concentration and is not necessarily the same as chaotropes used for the solubilization. In most cases the refolding/oxidation solution will also contain a reducing agent or the reducing agent plus its oxidized form in a specific ratio to generate a particular redox potential allowing for disulfide shuffling to occur in the formation of the protein's cysteine bridge(s). Some of the commonly used redox couples include cysteine/cystamine, glutathione (GSH)/dithiobis GSH, cupric chloride, dithiothreitol (DTT)/dithiane DTT, and 2-mercaptoethanol(bME)/di-thio-b(ME). In many instances, a cosolvent may be used to increase the efficiency of the refolding, and common reagents used for this purpose include glycerol, polyethylene glycol of various molecular weights, arginine and the like.

Immunoconjugates

The disclosure also provides immunoconjugates (interchangeably termed "antibody-drug conjugates" or "ADC"), comprising any of the humanized antibodies comprising an ultralong CDR3 as described herein conjugated to a cytotoxic agent such as a chemotherapeutic agent, a drug, a growth inhibitory agent, a toxin (e.g., an enzymatically active toxin of bacterial, fungal, plant, or animal origin, or fragments thereof), or a radioactive isotope (e.g., a radioconjugate).

The use of antibody-drug conjugates for the local delivery of cytotoxic or cytostatic agents. For example, drugs to kill or inhibit tumor cells in the treatment of cancer (Syrigos and Epenetos (1999) Anticancer Research 19:605-614; Niculescu-Duvaz and Springer (1997) Adv. Drg Del. Rev. 26:151-172; U.S. Pat. No. 4,975,278) allows targeted delivery of the drug moiety to tumors, and intracellular accumulation therein, where systemic administration of these unconjugated drug agents may result in unacceptable levels of toxicity to normal cells as well as the tumor cells sought to be eliminated (Baldwin et al., (1986) Lancet pp. (Mar. 15, 1986):603-05; Thorpe, (1985) "Antibody Carriers Of Cytotoxic Agents In Cancer Therapy: A Review," in Monoclonal Antibodies '84: Biological And Clinical Applications, A. Pinchera et al. (ed.s), pp. 475-506). Maximal efficacy with minimal toxicity is sought thereby. Both polyclonal antibodies and monoclonal antibodies have been reported as useful in these strategies (Rowland et al., (1986) Cancer Immunol. Immunother., 21:183-87). Drugs used in these methods include daunomycin, doxorubicin, methotrexate, and vindesine (Rowland et al., (1986) Supra). Toxins used in antibody-toxin conjugates include bacterial toxins such as diphtheria toxin, plant toxins such as ricin, small molecule toxins such as geldanamycin (Mandler et al (2000) Jour. of the Nat. Cancer Inst. 92(19): 1573-1581; Mandler et al (2000) Bioorganic & Med. Chem. Letters 10: 1025-1028; Mandler et al (2002) Bioconjugate Chem. 13:786-791), maytansinoids (EP 1391213; Liu et al., (1996) Proc. Natl. Acad. Sci. USA 93:8618-8623), and calicheamicin (Lode et al (1998) Cancer Res. 58:2928; Hinman et al (1993) Cancer Res. 53:3336-3342). The toxins may effect their cytotoxic and cytostatic effects by mechanisms including tubulin binding, DNA binding, or topoisomerase inhibition. Some cytotoxic drugs tend to be inactive or less active when conjugated to large antibodies or protein receptor ligands.

ZEVALIN® (ibritumomab tiuxetan, Biogen/Idec) is an antibody-radioisotope conjugate composed of a murine IgG1 kappa monoclonal antibody directed against the CD20 antigen found on the surface of normal and malignant B lymphocytes and $^{111}$In or $^{90}$Y radioisotope bound by a thiourea linker-chelator (Wiseman et al (2000) Eur. Jour. Nucl. Med. 27(7):766-77; Wiseman et al (2002) Blood 99(12):4336-42; Witzig et al (2002) J. Clin. Oncol. 20(10): 2453-63; Witzig et al (2002) J. Clin. Oncol. 20(15):3262-69). Although ZEVALIN has activity against B-cell non-Hodgkin's Lymphoma (NHL), administration results in severe and prolonged cytopenias in most patients. MYLO-TARG™ (gemtuzumab ozogamicin, Wyeth Pharmaceuticals), an antibody drug conjugate composed of a hu CD33 antibody linked to calicheamicin, was approved in 2000 for the treatment of acute myeloid leukemia by injection (Drugs of the Future (2000) 25(7):686; U.S. Pat. Nos. 4,970,198; 5,079,233; 5,585,089; 5,606,040; 5,693,762; 5,739,116; 5,767,285; 5,773,001). Cantuzumab mertansine (Immunogen, Inc.), an antibody drug conjugate composed of the huC242 antibody linked via the disulfide linker SPP to the maytansinoid drug moiety, DM1, is advancing into Phase II trials for the treatment of cancers that express CanAg, such as colon, pancreatic, gastric, and others. MLN-2704 (Millennium Pharm., BZL Biologics, Immunogen Inc.), an antibody drug conjugate composed of the anti-prostate specific membrane antigen (PSMA) monoclonal antibody linked to the maytansinoid drug moiety, DM1, is under development for the potential treatment of prostate tumors. The auristatin peptides, auristatin E (AE) and monomethylauristatin (MMAE), synthetic analogs of dolastatin, were conjugated to chimeric monoclonal antibodies cBR96 (specific to Lewis Y on carcinomas) and cAC 10 (specific to CD30 on hematological malignancies) (Doronina et al (2003) Nature Biotechnology 21(7):778-784) and are under therapeutic development.

Chemotherapeutic agents useful in the generation of immunoconjugates are described herein. Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes. See, e.g., WO 93/21232 published Oct. 28, 1993. A variety of radionuclides are available for the production of radioconjugated antibodies. Examples include $^{212}$Bi, $^{131}$I, $^{131}$In, $^{90}$Y, and $^{186}$Re. Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin may be prepared as described in Vitetta et al., Science, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

Conjugates of an antibody and one or more small molecule toxins, such as a calicheamicin, maytansinoids, dolastatins, aurostatins, a trichothecene, and CC 1065, and the derivatives of these toxins that have toxin activity, are also contemplated herein.

a. Maytansine and Maytansinoids

In some embodiments, the immunoconjugate comprises a humanized antibody (full length or fragments) comprising an ultralong CDR3 as disclosed herein conjugated to one or more maytansinoid molecules.

Maytansinoids are mitototic inhibitors which act by inhibiting tubulin polymerization. Maytansine was first isolated from the east African shrub *Maytenus serrata* (U.S. Pat. No. 3,896,111). Subsequently, it was discovered that certain microbes also produce maytansinoids, such as maytansinol and C-3 maytansinol esters (U.S. Pat. No. 4,151,042). Synthetic maytansinol and derivatives and analogues thereof are disclosed, for example, in U.S. Pat. Nos. 4,137,230; 4,248, 870; 4,256,746; 4,260,608; 4,265,814; 4,294,757; 4,307, 016; 4,308,268; 4,308,269; 4,309,428; 4,313,946; 4,315, 929; 4,317,821; 4,322,348; 4,331,598; 4,361,650; 4,364, 866; 4,424,219; 4,450,254; 4,362,663; and 4,371,533.

Maytansinoid drug moieties are attractive drug moieties in antibody drug conjugates because they are: (i) relatively accessible to prepare by fermentation or chemical modification, derivatization of fermentation products, (ii) amenable to derivatization with functional groups suitable for conjugation through the non-disulfide linkers to antibodies, (iii) stable in plasma, and (iv) effective against a variety of tumor cell lines.

Immunoconjugates containing maytansinoids, methods of making same, and their therapeutic use are disclosed, for example, in U.S. Pat. Nos. 5,208,020, 5,416,064 and EP 0 425 235. Liu et al., Proc. Natl. Acad. Sci. USA 93:8618-8623 (1996) described immunoconjugates comprising a maytansinoid designated DM1 linked to the monoclonal antibody C242 directed against human colorectal cancer. The conjugate was found to be highly cytotoxic towards cultured colon cancer cells, and showed antitumor activity in an in vivo tumor growth assay. Chari et al., Cancer Research 52:127-131 (1992) describe immunoconjugates in which a maytansinoid was conjugated via a disulfide linker to the murine antibody A7 binding to an antigen on human colon cancer cell lines, or to another murine monoclonal antibody TA. 1 that binds the HER-2/neu oncogene. The cytotoxicity of the TA. 1-maytansinoid conjugate was tested in vitro on the human breast cancer cell line SK-BR-3, which expresses $3\times10^5$ HER-2 surface antigens per cell. The drug conjugate achieved a degree of cytotoxicity similar to the free maytansinoid drug, which could be increased by increasing the number of maytansinoid molecules per antibody molecule. The A7-maytansinoid conjugate showed low systemic cytotoxicity in mice.

Antibody-maytansinoid conjugates are prepared by chemically linking an antibody to a maytansinoid molecule without significantly diminishing the biological activity of either the antibody or the maytansinoid molecule. See, e.g., U.S. Pat. No. 5,208,020. An average of 3-4 maytansinoid molecules conjugated per antibody molecule has shown efficacy in enhancing cytotoxicity of target cells without negatively affecting the function or solubility of the antibody, although even one molecule of toxin/antibody would be expected to enhance cytotoxicity over the use of naked antibody. Maytansinoids are well known in the art and can be synthesized by known techniques or isolated from natural sources. Suitable maytansinoids are disclosed, for example, in U.S. Pat. No. 5,208,020 and in the other patents and nonpatent publications referred to hereinabove. Preferred maytansinoids are maytansinol and maytansinol analogues modified in the aromatic ring or at other positions of the maytansinol molecule, such as various maytansinol esters.

There are many linking groups known in the art for making antibody-maytansinoid conjugates, including, for example, those disclosed in U.S. Pat. Nos. 5,208,020, 6,441, 163, or EP Patent 0 425 235, Chari et al., Cancer Research 52:127-131 (1992). Antibody-maytansinoid conjugates comprising the linker component SMCC may be prepared. The linking groups include disulfide groups, thioether groups, acid labile groups, photolabile groups, peptidase labile groups, or esterase labile groups, as disclosed in the above-identified patents, disulfide and thioether groups being preferred. Additional linking groups are described and exemplified herein.

Conjugates of the antibody and maytansinoid may be made using a variety of bifunctional protein coupling agents such as N-succinimidyl-3-(2-pyridyldithio) propionate (SPDP), succinimidyl-4-(N-maleimidomethyl)cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2, 4-dinitrobenzene). Particularly preferred coupling agents include N-succinimidyl-3-(2-pyridyldithio) propionate (SPDP) (Carlsson et al., Biochem. J. 173:723-737 (1978)) and N-succinimidyl-4-(2-pyridylthio)pentanoate (SPP) to provide for a disulfide linkage.

The linker may be attached to the maytansinoid molecule at various positions, depending on the type of the link. For example, an ester linkage may be formed by reaction with a hydroxyl group using conventional coupling techniques. The reaction may occur at the C-3 position having a hydroxyl group, the C-14 position modified with hydroxymethyl, the C-15 position modified with a hydroxyl group, and the C-20 position having a hydroxyl group. In a preferred embodiment, the linkage is formed at the C-3 position of maytansinol or a maytansinol analogue.

b. Auristatins and Dolastatins

In some embodiments, the immunoconjugate comprises an antibody disclosed herein conjugated to dolastatins or dolostatin peptidic analogs and derivatives, the auristatins (U.S. Pat. Nos. 5,635,483; 5,780,588). Dolastatins and auristatins have been shown to interfere with microtubule dynamics, GTP hydrolysis, and nuclear and cellular division (Woyke et al (2001) Antimicrob. Agents and Chemother. 45(12):3580-3584) and have anticancer (U.S. Pat. No. 5,663,149) and antifungal activity (Pettit et al (1998) Antimicrob. Agents Chemother. 42:2961-2965). The dolastatin or auristatin drug moiety may be attached to the antibody through the N (amino) terminus or the C (carboxyl) terminus of the peptidic drug moiety (WO 02/088172).

Exemplary auristatin embodiments include the N-terminus linked monomethylauristatin drug moieties DE and DF, (see, e.g., U.S. Pat. No. 7,498,298).

Typically, peptide-based drug moieties can be prepared by forming a peptide bond between two or more amino acids and/or peptide fragments. Such peptide bonds can be prepared, for example, according to the liquid phase synthesis method (see, e.g., E. Schroder and K. Lubke, "The Peptides", volume 1, pp 76-136, 1965, Academic Press) that is well known in the field of peptide chemistry. The auristatin/dolastatin drug moieties may be prepared according to the methods of: U.S. Pat. Nos. 5,635,483; 5,780,588; Pettit et al (1989) J. Am. Chem. Soc. 111:5463-5465; Pettit et al. (1998) Anti-Cancer Drug Design 13:243-277; Pettit, G. R., et al. Synthesis, 1996, 719-725; and Pettit et al. (1996) J. Chem. Soc. Perkin Trans. 1 5:859-863. See also Doronina (2003) Nat Biotechnol 21(7):778-784; U.S. Pat. No. 7,498,289, (disclosing, linkers and methods of preparing monomethylvaline compounds such as MMAE and MMAF conjugated to linkers).

c. Calicheamicin

In other embodiments, the immunoconjugate comprises an antibody disclosed herein conjugated to one or more calicheamicin molecules. The calicheamicin family of antibiotics are capable of producing double-stranded DNA breaks at sub-picomolar concentrations. For the preparation of conjugates of the calicheamicin family, see U.S. Pat. Nos. 5,712,374, 5,714,586, 5,739,116, 5,767,285, 5,770,701, 5,770,710, 5,773,001, 5,877,296. Structural analogues of calicheamicin which may be used include, but are not limited to, $\gamma_1^I$, $\alpha_2^I$, $\alpha_3^I$, N-acetyl-$\gamma_1^I$, PSAG and $\theta^I_1$ (see, e.g., Hinman et al., Cancer Research 53:3336-3342 (1993), Lode et al., Cancer Research 58:2925-2928 (1998) and the aforementioned U.S. patents). Another anti-tumor drug that the antibody can be conjugated is QFA which is an antifolate. Both calicheamicin and QFA have intracellular sites of action and do not readily cross the plasma membrane. Therefore, cellular uptake of these agents through antibody mediated internalization greatly enhances their cytotoxic effects.

d. Other Cytotoxic Agents

Other antitumor agents that can be conjugated to the antibodies disclosed herein include BCNU, streptozoicin, vincristine and 5-fluorouracil, the family of agents known collectively LL-E33288 complex described in U.S. Pat. Nos. 5,053,394, 5,770,710, as well as esperamicins (U.S. Pat. No. 5,877,296).

Enzymatically active toxins and fragments thereof which can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin and the tricothecenes. See, for example, WO 93/21232 published Oct. 28, 1993.

The present disclosure further contemplates an immunoconjugate formed between an antibody and a compound with nucleolytic activity (e.g., a ribonuclease or a DNA endonuclease such as a deoxyribonuclease; DNase).

For selective destruction of the tumor, the antibody may comprise a highly radioactive atom. A variety of radioactive isotopes are available for the production of radioconjugated antibodies. Examples include $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu. When the conjugate is used for detection, it may comprise a radioactive atom for scintigraphic studies, for example $tc^{99m}$ or $I^{123}$, or a spin label for nuclear magnetic resonance (NMR) imaging (also known as magnetic resonance imaging, mri), such as iodine-123 again, iodine-131, indium-Ill, fluorine-19, carbon-13, nitrogen-15, oxygen-17, gadolinium, manganese or iron.

The radiolabels or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as $tc^{99m}$ or $I^{123}$, $Re^{186}$, $Re^{188}$ and $In^{111}$ can be attached via a cysteine residue in the peptide. Yttrium-90 can be attached via a lysine residue. The IODOGEN method (Fraker et al (1978) Biochem. Biophys. Res. Commun. 80: 49-57) can be used to incorporate iodine-123. "Monoclonal Antibodies in Immunoscintigraphy" (Chatal, CRC Press 1989) describes other methods.

Conjugates of the antibody and cytotoxic agent may be made using a variety of bifunctional protein coupling agents such as N-succinimidyl-3-(2-pyridyldithio) propionate (SPDP), succinimidyl-4-(N-maleimidomethyl)cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., Cancer Research 52:127-131 (1992); U.S. Pat. No. 5,208,020) may be used.

The compounds disclosed herein expressly contemplate, but are not limited to, ADC prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A). See pages 467-498, 2003-2004 Applications Handbook and Catalog.

e. Preparation of Antibody Drug Conjugates

In the antibody drug conjugates (ADC) disclosed herein, an antibody (Ab) is conjugated to one or more drug moieties (D), e.g., about 1 to about 20 drug moieties per antibody, through a linker (L). An ADC of Formula I [Ab-(L-D)$_p$] may be prepared by several routes, employing organic chemistry reactions, conditions, and reagents known to those skilled in the art, including: (1) reaction of a nucleophilic group of an antibody with a bivalent linker reagent, to form Ab-L, via a covalent bond, followed by reaction with a drug moiety D; and (2) reaction of a nucleophilic group of a drug moiety with a bivalent linker reagent, to form D-L, via a covalent bond, followed by reaction with the nucleophilic group of an antibody. Additional methods for preparing ADC are described herein.

The linker may be composed of one or more linker components. Exemplary linker components include 6-maleimidocaproyl ("MC"), maleimidopropanoyl ("MP"), valine-citrulline ("val-cit"), alanine-phenylalanine ("ala-phe"), p-aminobenzyloxycarbonyl ("PAB"), N-Succinimidyl p-aminobenzyloxycarbonyl ("PAB"), N-Succinimidyl 4-(2-pyridylthio) pentanoate ("SPP"), N-Succinimidyl 4-(N-maleimidomethyl)cyclohexane-1 carboxylate ("SMCC"), and N-Succinimidyl (4-iodo-acetyl)aminobenzoate ("SIAB"). Additional linker components are known in the art and some are disclosed herein (see, e.g., U.S. Pat. No. 7,498,298).

In some embodiments, the linker may comprise amino acid residues. Exemplary amino acid linker components include a dipeptide, a tripeptide, a tetrapeptide or a pentapeptide. Exemplary dipeptides include: valine-citrulline (vc or val-cit), alanine-phenylalanine (af or ala-phe). Exemplary tripeptides include: glycine-valine-citrulline (gly-val-cit) and glycine-glycine-glycine (gly-gly-gly). Amino acid residues which comprise an amino acid linker component include those occurring naturally, as well as minor amino acids and non-naturally occurring amino acid analogs, such as citrulline. Amino acid linker components can be designed and optimized in their selectivity for enzymatic cleavage by a particular enzymes, for example, a tumor-associated protease, cathepsin B, C and D, or a plasmin protease.

Nucleophilic groups on antibodies include, but are not limited to: (i) N-terminal amine groups, (ii) side chain amine groups, e.g., lysine, (iii) side chain thiol groups, e.g., cysteine, and (iv) sugar hydroxyl or amino groups where the antibody is glycosylated. Amine, thiol, and hydroxyl groups are nucleophilic and capable of reacting to form covalent bonds with electrophilic groups on linker moieties and linker reagents including: (i) active esters such as NHS esters, HOBt esters, haloformates, and acid halides; (ii) alkyl and benzyl halides such as haloacetamides; (iii) aldehydes, ketones, carboxyl, and maleimide groups. Certain antibodies have reducible interchain disulfides, e.g., cysteine bridges. Antibodies may be made reactive for conjugation with linker reagents by treatment with a reducing agent such as DTT (dithiothreitol). Each cysteine bridge will thus form, theoretically, two reactive thiol nucleophiles. Additional nucleophilic groups can be introduced into antibodies through the reaction of lysines with 2-iminothiolane (Traut's reagent) resulting in conversion of an amine into a thiol. Reactive thiol groups may be introduced into the antibody (or fragment thereof) by introducing one, two, three, four, or more cysteine residues (e.g., preparing mutant antibodies comprising one or more non-native cysteine amino acid residues).

Antibody drug conjugates disclosed herein may also be produced by modification of the antibody to introduce electrophilic moieties, which can react with nucleophilic substituents on the linker reagent or drug. The sugars of glycosylated antibodies may be oxidized, e.g., with periodate oxidizing reagents, to form aldehyde or ketone groups which may react with the amine group of linker reagents or drug moieties. The resulting imine Schiff base groups may form a stable linkage, or may be reduced, e.g., by borohydride reagents to form stable amine linkages. In one embodiment, reaction of the carbohydrate portion of a glycosylated antibody with either glactose oxidase or sodium meta-periodate may yield carbonyl (aldehyde and ketone) groups in the protein that can react with appropriate groups on the drug (Hermanson, Bioconjugate Techniques). In another embodiment, proteins containing N-terminal serine or threonine residues can react with sodium meta-periodate, resulting in production of an aldehyde in place of the first amino acid (Geoghegan & Stroh, (1992) Bioconjugate Chem. 3:138-146; U.S. Pat. No. 5,362,852). Such aldehyde can be reacted with a drug moiety or linker nucleophile.

Likewise, nucleophilic groups on a drug moiety include, but are not limited to: amine, thiol, hydroxyl, hydrazide, oxime, hydrazine, thiosemicarbazone, hydrazine carboxylate, and arylhydrazide groups capable of reacting to form covalent bonds with electrophilic groups on linker moieties and linker reagents including: (i) active esters such as NHS esters, HOBt esters, haloformates, and acid halides; (ii) alkyl and benzyl halides such as haloacetamides; (iii) aldehydes, ketones, carboxyl, and maleimide groups.

Alternatively, a fusion protein comprising the antibody and cytotoxic agent may be made, e.g., by recombinant techniques or peptide synthesis. The length of DNA may comprise respective regions encoding the two portions of the conjugate either adjacent one another or separated by a region encoding a linker peptide which does not destroy the desired properties of the conjugate.

In yet another embodiment, the antibody may be conjugated to a "receptor" (such streptavidin) for utilization in tumor pre-targeting wherein the antibody-receptor conjugate is administered to the patient, followed by removal of unbound conjugate from the circulation using a clearing agent and then administration of a "ligand" (e.g., avidin) which is conjugated to a cytotoxic agent (e.g., a radionucleotide).

Engineered Hybridomas

Hybridoma cells can be generated by fusing B cells producing a desired antibody with an immortalized cell line, usually a myeloma cell line, so that the resulting fusion cells will be an immortalized cell line that secrets a particular antibody. By the same principle, myeloma cells can be first transfected with a nucleic acid encoding a germline antibody V region and can be screened for the expression of the germline V region. Those myeloma cells with highest level of proteolytic light chain expression can be subsequently fused with B cells that produce an antibody with desired target protein specificity. The fusion cells will produce two types of antibodies: one is a heterologous antibody containing an endogenous antibody chain (either heavy or light) operably joined to the recombinant germline V region (either heavy or light), and the other is the same antibody that the parental B cells would secrete (e.g. both endogenous heavy and light chains). The operably joined heterologous heavy and light chains can be isolated by conventional methods such as chromatography and identification can be confirmed by target protein binding assays, assays identifying a unique tag of the germline polypeptide, or endopeptidase activity assays described in other sections of this disclosure. In some cases, where the heterologous antibody is the predominant type in quantity among the two types of antibodies, such isolation may not be needed. Hybridomas. Including bovine hybridomas, may be a source of bovine antibody gene sequences, including ultralong CDR3 sequences.

Transgenic Mammals

A nucleic acid sequence encoding a germline antibody polypeptide of the present disclosure can be introduced into a non-human mammal to generate a transgenic animal that expresses the germline antibody polypeptide. Unlike the transgenic animal models more commonly seen, the transgene expressed by the transgenic mammals of the present disclosure need not replace at least one allele of the endogenous coding sequence responsible for the variable regions of antibody chains following somatic recombination. Due to allelic exclusion, the presence of an exogenous, post-somatic rearrangement version of the germline V region DNA will inhibit the endogenous alleles of pre-somatic rearrangement V minigenes from undergoing somatic rearrangement and contributing to the makeup of antibody chains this mammal may produce. Thus, when exposed to a particular antigen, the mammal will generate heterologous antibodies comprising one endogenously rearranged antibody chain, and one transgenic gene which was rearranged a priori. Such heterologous antibodies are invaluable in research and in treating certain conditions in live subjects. On the other hand, a method that directs the integration of the transgene to the locus of an endogenous allele will fully serve the purpose of practicing the present disclosure as well.

The general methods of generating transgenic animals have been well established and frequently practiced. For reviews and protocols for generating transgenic animals and related methods for genetic manipulations, see, e.g., Mansour et al., Nature 336:348-352 (1988); Capecchi et al., Trends Genet. 5:70-76 (1989); Capecchi, Science 244:1288-1292 (1989); Capecchi et al., Current Communications in Molecular Biology, pp 45-52, Capecchi, M. R. (ed.), Cold Spring Harbor Press, Cold Spring Harbor, N.Y. (1989); Frohman et al., Cell 56: 145-147 (1989); Brinster et al., Proc. Natl. Acad. Sci. USA 82:4438-4442 (1985); Evans et. al., Nature 292:154-156 (1981); Bradley et al., Nature 309:255-258 (1984); Gossler et al., Proc. Natl. Acad. Sci. USA 83:9065-9069 (1986); Robertson et al., Nature 322: 445-448 (1986); Jaenisch Science 240:1468-1474 (1988); and Siedel, G. E., Jr., "Critical review of embryo transfer procedures with cattle" in Fertilization and Embryonic Development in Vitro, page 323, L. Mastroianni, Jr. and J. D. Biggers, ed., Plenum Press, New York, N.Y. (1981).

An exemplary transgenic animal of the present disclosure is mouse, whereas a number of other transgenic animals can also be produced using the same general method. These animals include, but are not limited to: rabbits, sheep, cattle, and pigs (Jaenisch Science 240:1468-1474 (1988); Hammer et al., J. Animal. Sci. 63:269 (1986); Hammer et al. Nature 315:680 (1985); Wagner et al., Theriogenology 21:29 (1984)).

Pharmaceutical Compositions

Humanized antibodies comprising an ultralong CDR3, antibody fragments, nucleic acids, or vectors disclosed herein can be formulated in compositions, especially pharmaceutical compositions. Such compositions with humanized antibodies comprising an ultralong CDR3 comprise a therapeutically or prophylactically effective amount of a humanized antibodies comprising an ultralong CDR3, antibody fragment, nucleic acid, or vector disclosed herein in admixture with a suitable carrier, e.g., a pharmaceutically acceptable agent. Typically, humanized antibodies comprising an ultralong CDR3, antibody fragments, nucleic acids, or vectors disclosed herein are sufficiently purified for administration before formulation in a pharmaceutical composition.

Pharmaceutically acceptable agents for use in the present pharmaceutical compositions include carriers, excipients, diluents, antioxidants, preservatives, coloring, flavoring and diluting agents, emulsifying agents, suspending agents, solvents, fillers, bulking agents, buffers, delivery vehicles, tonicity agents, cosolvents, wetting agents, complexing agents, buffering agents, antimicrobials, and surfactants.

Neutral buffered saline or saline mixed with serum albumin are exemplary appropriate carriers. The pharmaceutical compositions may include antioxidants such as ascorbic acid; low molecular weight polypeptides; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as Tween, pluronics, or polyethylene glycol (PEG). Also by way of example, suitable tonicity enhancing agents include alkali metal halides (preferably sodium or potassium chloride), mannitol, sorbitol, and the like. Suitable preservatives include benzalkonium chloride, thimerosal, phenethyl alcohol, methylparaben, propylparaben, chlorhexidine, sorbic acid and the like. Hydrogen peroxide also may be used as preservative. Suitable cosolvents include glycerin, propylene glycol, and PEG. Suitable complexing agents include caffeine, polyvinylpyrrolidone, beta-cyclodextrin or hydroxy-propyl-beta-cyclodextrin. Suitable surfactants or wetting agents include sorbitan esters, polysorbates such as polysorbate 80, tromethamine, lecithin, cholesterol, tyloxapal, and the like. The buffers may be conventional buffers such as acetate, borate, citrate, phosphate, bicarbonate, or Tris-HCl. Acetate buffer may be about pH 4-5.5, and Tris buffer can be about pH 7-8.5. Additional pharmaceutical agents are set forth in Remington's Pharmaceutical Sciences, 18th Edition, A. R. Gennaro, ed., Mack Publishing Company, 1990.

The composition may be in liquid form or in a lyophilized or freeze-dried form and may include one or more lyoprotectants, excipients, surfactants, high molecular weight structural additives and/or bulking agents (see, for example, U.S. Pat. Nos. 6,685,940, 6,566,329, and 6,372,716). In one embodiment, a lyoprotectant is included, which is a non-reducing sugar such as sucrose, lactose or trehalose. The amount of lyoprotectant generally included is such that, upon reconstitution, the resulting formulation will be isotonic, although hypertonic or slightly hypotonic formulations also may be suitable. In addition, the amount of lyoprotectant should be sufficient to prevent an unacceptable amount of degradation and/or aggregation of the protein upon lyophilization. Exemplary lyoprotectant concentrations for sugars (e.g., sucrose, lactose, trehalose) in the pre-lyophilized formulation are from about 10 mM to about 400 mM. In another embodiment, a surfactant is included, such as for example, nonionic surfactants and ionic surfactants such as polysorbates (e.g., polysorbate 20, polysorbate 80); poloxamers (e.g., poloxamer 188); poly(ethylene glycol) phenyl ethers (e.g., Triton); sodium dodecyl sulfate (SDS); sodium laurel sulfate; sodium octyl glycoside; lauryl-, myristyl-, linoleyl-, or stearyl-sulfobetaine; lauryl-, myristyl-, linoleyl- or stearyl-sarcosine; linoleyl, myristyl-, or cetyl-betaine; lauroamidopropyl-, cocamidopropyl-, linoleamidopropyl-, myristamidopropyl-, palmidopropyl-, or isostearamidopropyl-betaine (e.g., lauroamidopropyl); myristamidopropyl-, palmidopropyl-, or isostearamidopropyl-dimethylamine; sodium methyl cocoyl-, or disodium methyl ofeyl-taurate; and the MONAQUAT™. series (Mona Industries, Inc., Paterson, N.J.), polyethyl glycol, polypropyl glycol, and copolymers of ethylene and propylene glycol (e.g., Pluronics, PF68 etc). Exemplary amounts of surfactant that may be present in the pre-lyophilized formulation are from about 0.001-0.5%. High molecular weight structural additives (e.g., fillers, binders) may include for example, acacia, albumin, alginic acid, calcium phosphate (dibasic), cellulose, carboxymethylcellulose, carboxymethylcellulose sodium, hydroxyethylcellulose, hydroxypropylcellulose, hydroxypropylmethylcellulose, microcrystalline cellulose, dextran, dextrin, dextrates, sucrose, tylose, pregelatinized starch, calcium sulfate, amylose, glycine, bentonite, maltose, sorbitol, ethylcellulose, disodium hydrogen phosphate, disodium phosphate, disodium pyrosulfite, polyvinyl alcohol, gelatin, glucose, guar gum, liquid glucose, compressible sugar, magnesium aluminum silicate, maltodextrin, polyethylene oxide, polymethacrylates, povidone, sodium alginate, tragacanth microcrystalline cellulose, starch, and zein. Exemplary concentrations of high molecular weight structural additives are from 0.1% to 10% by weight. In other embodiments, a bulking agent (e.g., mannitol, glycine) may be included.

Compositions may be suitable for parenteral administration. Exemplary compositions are suitable for injection or infusion into an animal by any route available to the skilled worker, such as intraarticular, subcutaneous, intravenous, intramuscular, intraperitoneal, intracerebral (intraparenchymal), intracerebroventricular, intramuscular, intraocular, intraarterial, or intralesional routes. A parenteral formulation typically will be a sterile, pyrogen-free, isotonic aqueous solution, optionally containing pharmaceutically acceptable preservatives.

Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringers' dextrose, dextrose and sodium chloride, lactated Ringer's, or fixed oils. Intravenous vehicles include fluid and nutrient replenishers, electrolyte replenishers, such as those based on Ringer's dextrose, and the like. Preservatives and other additives may also be present, such as, for example, anti-microbials, anti-oxidants, chelating agents, inert gases and the like. See generally, Remington's Pharmaceutical Science, 16th Ed., Mack Eds., 1980.

Pharmaceutical compositions described herein may be formulated for controlled or sustained delivery in a manner that provides local concentration of the product (e.g., bolus, depot effect) and/or increased stability or half-life in a particular local environment. The compositions can include the formulation of humanized antibodies comprising an ultralong CDR3, antibody fragments, nucleic acids, or vectors disclosed herein with particulate preparations of polymeric compounds such as polylactic acid, polyglycolic acid, etc., as well as agents such as a biodegradable matrix, injectable microspheres, microcapsular particles, microcapsules, bioerodible particles beads, liposomes, and implantable delivery devices that provide for the controlled or sustained release of the active agent which then can be delivered as a depot injection. Techniques for formulating such sustained- or controlled-delivery means are known and a variety of polymers have been developed and used for the controlled release and delivery of drugs. Such polymers are typically biodegradable and biocompatible. Polymer hydrogels, including those formed by complexation of enantiomeric polymer or polypeptide segments, and hydrogels with temperature or pH sensitive properties, may be desirable for providing drug depot effect because of the mild and aqueous conditions involved in trapping bioactive protein agents (e.g., humanized antibodies comprising an ultralong CDR3). See, for example, the description of controlled release porous polymeric microparticles for the delivery of pharmaceutical compositions in WO 93/15722.

Suitable materials for this purpose include polylactides (see, e.g., U.S. Pat. No. 3,773,919), polymers of poly-(a-hydroxycarboxylic acids), such as poly-D-(−)-3-hydroxybutyric acid (EP 133,988A), copolymers of L-glutamic acid and gamma ethyl-L-glutamate (Sidman et al., Biopolymers, 22: 547-556 (1983)), poly(2-hydroxyethyl-methacrylate) (Langer et al., J. Biomed. Mater. Res., 15: 167-277 (1981), and Langer, Chem. Tech., 12: 98-105 (1982)), ethylene vinyl acetate, or poly-D(−)-3-hydroxybutyric acid. Other biodegradable polymers include poly(lactones), poly(acetals), poly(orthoesters), and poly(orthocarbonates). Sustained-release compositions also may include liposomes, which can be prepared by any of several methods known in the art (see, e.g., Eppstein et al., Proc. Natl. Acad. Sci. USA, 82: 3688-92 (1985)). The carrier itself, or its degradation products, should be nontoxic in the target tissue and should not further aggravate the condition. This can be determined by routine screening in animal models of the target disorder or, if such models are unavailable, in normal animals.

Microencapsulation of recombinant proteins for sustained release has been performed successfully with human growth hormone (rhGH), interferon-(rhIFN-), interleukin-2, and MN rgp120. Johnson et al., Nat. Med., 2:795-799 (1996); Yasuda, Biomed. Ther., 27:1221-1223 (1993); Hora et al., Bio/Technology. 8:755-758 (1990); Cleland, "Design and Production of Single Immunization Vaccines Using Polylactide Polyglycolide Microsphere Systems," in Vaccine Design: The Subunit and Adjuvant Approach, Powell and Newman, eds, (Plenum Press: New York, 1995), pp. 439-462; WO 97/03692, WO 96/40072, WO 96/07399; and U.S. Pat. No. 5,654,010. The sustained-release formulations of these proteins were developed using poly-lactic-coglycolic acid (PLGA) polymer due to its biocompatibility and wide range of biodegradable properties. The degradation products of PLGA, lactic and glycolic acids can be cleared quickly within the human body. Moreover, the degradability of this polymer can be depending on its molecular weight and composition. Lewis, "Controlled release of bioactive agents from lactide/glycolide polymer," in: M. Chasin and R. Langer (Eds.), Biodegradable Polymers as Drug Delivery Systems (Marcel Dekker: New York, 1990), pp. 1-41. Additional examples of sustained release compositions include, for example, EP 58,481A, U.S. Pat. No. 3,887,699, EP 158,277A, Canadian Patent No. 1176565, U. Sidman et al., Biopolymers 22, 547 [1983], R. Langer et al., Chem. Tech. 12, 98 [1982], Sinha et al., J. Control. Release 90, 261 [2003], Zhu et al., Nat. Biotechnol. 18, 24 [2000], and Dai et al., Colloids Surf B Biointerfaces 41, 117 [2005].

Bioadhesive polymers are also contemplated for use in or with compositions of the present disclosure. Bioadhesives are synthetic and naturally occurring materials able to adhere to biological substrates for extended time periods. For example, Carbopol and polycarbophil are both synthetic cross-linked derivatives of poly(acrylic acid). Bioadhesive delivery systems based on naturally occurring substances include for example hyaluronic acid, also known as hyaluronan. Hyaluronic acid is a naturally occurring mucopolysaccharide consisting of residues of D-glucuronic and N-acetyl-D-glucosamine. Hyaluronic acid is found in the extracellular tissue matrix of vertebrates, including in connective tissues, as well as in synovial fluid and in the vitreous and aqueous humor of the eye. Esterified derivatives of hyaluronic acid have been used to produce microspheres for use in delivery that are biocompatible and biodegradable (see, for example, Cortivo et al., Biomaterials (1991) 12:727-730; EP 517,565; WO 96/29998; Illum et al., J. Controlled Rel. (1994) 29:133-141). Exemplary hyaluronic acid containing compositions of the present disclosure comprise a hyaluronic acid ester polymer in an amount of approximately 0.1% to about 40% (w/w) of a humanized antibody comprising an ultralong CDR3 to hyaluronic acid polymer.

Both biodegradable and non-biodegradable polymeric matrices may be used to deliver compositions of the present disclosure, and such polymeric matrices may comprise natural or synthetic polymers. Biodegradable matrices are preferred. The period of time over which release occurs is based on selection of the polymer. Typically, release over a period ranging from between a few hours and three to twelve months is most desirable. Exemplary synthetic polymers which may be used to form the biodegradable delivery system include: polymers of lactic acid and glycolic acid, polyamides, polycarbonates, polyalkylenes, polyalkylene glycols, polyalkylene oxides, polyalkylene terepthalates, polyvinyl alcohols, polyvinyl ethers, polyvinyl esters, polyvinyl halides, polyvinylpyrrolidone, polyglycolides, polysiloxanes, polyanhydrides, polyurethanes and co-polymers thereof, poly(butic acid), poly(valeric acid), alkyl cellulose, hydroxyalkyl celluloses, cellulose ethers, cellulose esters, nitro celluloses, polymers of acrylic and methacrylic esters, methyl cellulose, ethyl cellulose, hydroxypropyl cellulose, hydroxypropyl methyl cellulose, hydroxybutyl methyl cellulose, cellulose acetate, cellulose propionate, cellulose acetate butyrate, cellulose acetate phthalate, carboxylethyl cellulose, cellulose triacetate, cellulose sulphate sodium salt, poly(methyl methacrylate), poly(ethyl methacrylate), poly (butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), poly(octadecyl acrylate), polyethylene, polypropylene, poly (ethylene glycol), poly(ethylene oxide), poly(ethylene terephthalate), poly(vinyl alcohols), polyvinyl acetate, poly vinyl chloride, polystyrene and polyvinylpyrrolidone. Exemplary natural polymers include alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins, zein and other prolamines and hydrophobic proteins, copolymers and mixtures thereof. In general, these materials degrade either by enzymatic hydrolysis or exposure to water in vivo, by surface or bulk erosion. The polymer optionally is in the form of a hydrogel (see, for example, WO 04/009664, WO 05/087201, Sawhney, et al., Macromolecules, 1993, 26, 581-587) that can absorb up to about 90% of its weight in water and further, optionally is cross-linked with multi-valent ions or other polymers.

Delivery systems also include non-polymer systems that are lipids including sterols such as cholesterol, cholesterol esters and fatty acids or neutral fats such as mono-di- and tri-glycerides; hydrogel release systems; silastic systems; peptide based systems; wax coatings; compressed tablets using conventional binders and excipients; partially fused implants; and the like. Specific examples include, but are not limited to: (a) erosional systems in which the product is contained in a form within a matrix such as those described in U.S. Pat. Nos. 4,452,775, 4,675,189 and 5,736,152 and (b) diffusional systems in which a product permeates at a controlled rate from a polymer such as described in U.S. Pat. Nos. 3,854,480, 5,133,974 and 5,407,686. Liposomes containing the product may be prepared by methods known methods, such as for example (DE 3,218,121; Epstein et al., Proc. Natl. Acad. Sci. USA, 82: 3688-3692 (1985); Hwang et al., Proc. Natl. Acad. Sci. USA, 77: 4030-4034 (1980); EP 52,322; EP 36,676; EP 88,046; EP 143,949; EP 142,641; JP 83-118008; U.S. Pat. Nos. 4,485,045 and 4,544,545; and EP 102,324).

Alternatively or additionally, the compositions may be administered locally via implantation into the affected area of a membrane, sponge, or other appropriate material on to which a humanized antibody comprising an ultralong CDR3, antibody fragment, nucleic acid, or vector disclosed herein has been absorbed or encapsulated. Where an implantation device is used, the device may be implanted into any suitable tissue or organ, and delivery of a humanized antibody comprising an ultralong CDR3 antibody fragment, nucleic acid, or vector disclosed herein can be directly through the device via bolus, or via continuous administration, or via catheter using continuous infusion.

A pharmaceutical composition comprising a humanized antibody comprising an ultralong CDR3, antibody fragment, nucleic acid, or vector disclosed herein may be formulated for inhalation, such as for example, as a dry powder. Inhalation solutions also may be formulated in a liquefied propellant for aerosol delivery. In yet another formulation, solutions may be nebulized. Additional pharmaceutical composition for pulmonary administration include, those described, for example, in WO 94/20069, which discloses pulmonary delivery of chemically modified proteins. For pulmonary delivery, the particle size should be suitable for delivery to the distal lung. For example, the particle size may be from 1 μm to 5 μm; however, larger particles may be used, for example, if each particle is fairly porous.

Certain formulations containing humanized antibodies comprising an ultralong CDR3, antibody fragments, nucleic acids, or vectors disclosed herein may be administered orally. Formulations administered in this fashion may be formulated with or without those carriers customarily used in the compounding of solid dosage forms such as tablets and capsules. For example, a capsule can be designed to release the active portion of the formulation at the point in the gastrointestinal tract when bioavailability is maximized and pre-systemic degradation is minimized. Additional agents may be included to facilitate absorption of a selective binding agent. Diluents, flavorings, low melting point waxes, vegetable oils, lubricants, suspending agents, tablet disintegrating agents, and binders also can be employed.

Another preparation may involve an effective quantity of a humanized antibody comprising an ultralong CDR3, antibody fragment, nucleic acid, or vector disclosed herein in a mixture with non-toxic excipients which are suitable for the manufacture of tablets. By dissolving the tablets in sterile water, or another appropriate vehicle, solutions may be prepared in unit dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Suitable and/or preferred pharmaceutical formulations may be determined in view of the present disclosure and general knowledge of formulation technology, depending upon the intended route of administration, delivery format, and desired dosage. Regardless of the manner of administration, an effective dose may be calculated according to patient body weight, body surface area, or organ size. Further refinement of the calculations for determining the appropriate dosage for treatment involving each of the formulations described herein are routinely made in the art and is within the ambit of tasks routinely performed in the art. Appropriate dosages may be ascertained through use of appropriate dose-response data.

In some embodiments, humanized antibodies comprising an ultralong CDR3 or fragments thereof are provided with a modified Fc region where a naturally-occurring Fc region is modified to increase the half-life of the antibody or fragment in a biological environment, for example, the serum half-life or a half-life measured by an in vitro assay. Methods for altering the original form of a Fc region of an IgG also are described in U.S. Pat. No. 6,998,253.

In certain embodiments, it may be desirable to modify the antibody or fragment in order to increase its serum half-life, for example, adding molecules such as PEG or other water soluble polymers, including polysaccharide polymers, to antibody fragments to increase the half-life. This may also be achieved, for example, by incorporation of a salvage receptor binding epitope into the antibody fragment (e.g., by mutation of the appropriate region in the antibody fragment or by incorporating the epitope into a peptide tag that is then fused to the antibody fragment at either end or in the middle, e.g., by DNA or peptide synthesis) (see, International Publication No. WO96/32478). Salvage receptor binding epitope refers to an epitope of the Fc region of an IgG molecule (e.g., IgG1, IgG2, IgG3, or IgG4) that is responsible for increasing the in vivo serum half-life of the IgG molecule.

A salvage receptor binding epitope may include a region wherein any one or more amino acid residues from one or two loops of a Fc domain are transferred to an analogous position of the antibody fragment. Even more preferably, three or more residues from one or two loops of the Fc domain are transferred. Still more preferred, the epitope is taken from the CH2 domain of the Fc region (e.g., of an IgG) and transferred to the CH1, CH3, or VH region, or more than one such region, of the antibody. Alternatively, the epitope is taken from the CH2 domain of the Fc region and transferred to the $C_L$ region or $V_L$ region, or both, of the antibody fragment. See also WO 97/34631 and WO 96/32478 which describe Fc variants and their interaction with the salvage receptor.

Mutation of residues within Fc receptor binding sites may result in altered effector function, such as altered ADCC or CDC activity, or altered half-life. Potential mutations include insertion, deletion or substitution of one or more residues, including substitution with alanine, a conservative substitution, a non-conservative substitution, or replacement with a corresponding amino acid residue at the same position from a different IgG subclass (e.g., replacing an IgG1 residue with a corresponding IgG2 residue at that position). For example, it has been reported that mutating the serine at amino acid position 241 in IgG4 to proline (found at that position in IgG1 and IgG2) led to the production of a homogeneous antibody, as well as extending serum half-life and improving tissue distribution compared to the original chimeric IgG4. (Angal et al., Mol. Immunol. 30:105-8, 1993).

Kits/Articles of Manufacture

As an additional aspect, the present disclosure includes kits which comprise one or more compounds or compositions packaged in a manner which facilitates their use to practice methods of the present disclosure. In one embodiment, such a kit includes a compound or composition described herein (e.g., a composition comprising a humanized antibody comprising an ultralong CDR3 alone or in combination with a second agent), packaged in a container with a label affixed to the container or a package insert that describes use of the compound or composition in practicing the method. Suitable containers include, for example, bottles, vials, syringes, etc. The containers may be formed from a variety of materials such as glass or plastic. The container may have a sterile access port (for example the container may be an intravenous solution bag or a vial having a stopper pierceable by a hypodermic injection needle). The article of manufacture may comprise (a) a first container with a composition contained therein, wherein the composition comprises a humanized antibody comprising an ultralong CDR3 as disclosed herein; and (b) a second container with a composition contained therein, wherein the composition comprises a further therapeutic agent. The article of manufacture in this embodiment disclosed herein may further comprise a package insert indicating that the first and second compositions can be used to treat a particular condition. Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes. Preferably, the compound or composition is packaged in a unit dosage form. The kit may further include a device suitable for administering the composition according to a specific route of administration or for practicing a screening assay. Preferably, the kit contains a label that describes use of the humanized antibody comprising an ultralong CDR3 composition.

The following are examples of the methods and compositions of the disclosure. It is understood that various other embodiments may be practiced, given the general description provided above.

EXAMPLES

Example 1

At least 7 antibody heavy chain variable region sequences are publicly available that comprise an ultralong CDR3 of bovine origin. These sequences are shown in the alignment in FIG. 1. As shown in FIG. 1, the ultralong CDR3s present within these variable region sequences range in length from 56 to 61 amino acids. Strikingly, the sequence alignment indicates that the amino acid residues positioned in the N-terminal ends of the CDR3s are particularly conserved. Following the first cysteine residue in each of these variable region sequences, an amino acid sequence pattern of "TTVHQ" and variants thereof are found. This is unusual in that most heavy chain variable regions of most species end with the amino acid sequence "CAK" or "CAR". This unusual sequence motif (e.g., "TTVHQ") may be characteristic of the structure of an ultralong CDR3.

Additionally, the *Bos taurus* genome was searched and an undescribed heavy chain variable region DNA sequence in the antibody locus was found that encodes a "CTTVHQ" motif (e.g., SEQ ID NO: 1). This variable region sequence is designated herein as VH-UL (SEQ ID NO: 29). This sequence motif, discovered for the first time in searching the cow genome, is important in antibodies that comprise an ultralong CDR3.

To produce a humanized antibody comprising an ultralong CDR3, human variable regions for acceptor human frameworks were identified that are homologous to the bovine-derived VH-UL sequence (SEQ ID NO: 29). Several members of the human VH4 family were identified as being homologous to the VH-UL sequence, however none of VH4 family members contained a "CTTVHQ" motif. The sequences VH4-34*02 (SEQ ID NO: 33), VH4-39 (SEQ ID NO: 31), and VH4-59*03 (SEQ ID NO: 32) are the most homologous to the VH-UL sequence (see, e.g., FIG. 4B).

In a first exemplary method to produce a humanized antibody comprising an ultralong CDR3, a VH4-39 human acceptor framework (SEQ ID NO: 31) is used. The nucleotides encoding the last two amino acid residues of VH4-39 (e.g., "AR") are removed from the VH4-39 human acceptor framework, and nucleotides encoding a "TTVHQ" motif are added to the 3' end of the DNA sequence encoding the VH4-39 human acceptor framework after the nucleotides that encode the second cysteine residue of the VH4-39 human acceptor framework (e.g., after the nucleotides that code for amino acid position 97 of SEQ ID NO: 31). Next, the DNA encoding a portion of the ultralong CDR3 from BLV1H12 (e.g., the portion of the ultralong CDR3 beginning at the first glutamic acid residue (E) in BLV1H12; ETKKYQSCPDGYRERSDCSNRPACGTSDCCRVSVF-GNCLTTLPVSYSYTYNYEWHVD) is fused to the 3' end of the polynucleotide encoding the "TTVHQ" motif. Finally, DNA encoding a partial human JH4 region, beginning with the conserved tryptophan residue common to J region sequences, is added to the 3' end of the portion of the ultralong CDR3 sequence derived from BLV1H12. The following antibody gene encoding a partially human antibody comprising an ultralong CDR3 is derived:

```
                                          (SEQ ID NO: 377)
cagctgcagctgcaggagtcgggcccaggactggtgaagccttcggagac cctgtccctcacctgcactgtctctggtggctccatcagcagtagtagtt actactggggctggatccgccagccccagggaagggctggagtggatt gggagtatctattatagtgggagcacctactacaacccgtccctcaagag tcgagtcaccatatccgtagacacgtccaagaaccagttctccctgaagc tgagctctgtgaccgccgcagacacggctgtgtattactgtactactgtg caccagGAAACAAAAAAATACCAAAGTTGTCCTGATGGGTATAGAGAACG

TTCGGATTGTAGTAACAGACCTGCTTGTGGTACTAGTGATTGTTGTCGTG

TTAGTGTTTTTGGTAATTGTCTTACTACTCTTCCTGTGAGTTATAGTTAT

ACTTACAATTACGAATGGCACGTCGATGTCTGGGGCCAGGGAACCCTGGT

CACCGTCTCCTCAG

Regular Font - derived from human VH4-39

Underlined - derived from VH-UL

BOLD BLACK - ultralong CDR3, derived from
cow BLVH12

ITALICS - derived from human JH4
```

The amino acid sequence as translated from this partially human variable region gene is:

```
cagctgcagctgcaggagtcgggcccaggactggtgaagccttcggagaccctgtccctc
 Q   L   Q   L   Q   E   S   G   P   G   L   V   K   P   S   E   T   L   S   L acctgcactgtctctggtggctccatcagcagtagtagttactactggggctggatccgc
 T   C   T   V   S   G   G   S   I   S   S   S   S   Y   Y   W   G   W   I   R cagccccagggaagggctggagtggattgggagtatctattatagtgggagcacctac
 Q   P   P   G   K   G   L   E   W   I   G   S   I   Y   Y   S   G   S   T   Y
```

-continued
```
tacaacccgtccctcaagagtcgagtcaccatatccgtagacacgtccaagaaccagttc
 Y  N  P  S  Y  K  S  R  V  T  I  S  V  D  T  S  K  N  Q  F tccctgaagctgagctctgtgaccgccgcagacacggctgtgtattactgtactactgtg
 S  L  K  L  S  S  V  T  A  A  D  T  A  V  Y  Y  C  T  T  V caccaggaaacaaaaaaataccaaagttgtcctgatgggtatagagaacgttcggattgt
 H  Q  E  T  K  K  Y  Q  S  C  P  D  G  Y  R  E  R  S  D  C agtaacagacctgcttgtggtactagtgattgttgtcgtgttagtgtttttggtaattgt
 S  N  R  P  A  C  G  T  S  D  C  C  R  V  S  V  F  G  N  C cttactactcttcctgtgagttatagttatacttacaattacgaatggcacgtcgatgtc
 L  T  T  L  P  V  S  Y  S  Y  T  Y  N  Y  E  W  H  V  D  V tggggccagggaaccctggtcaccgtctcctcag  (SEQ ID NO: 377)
 W  G  Q  G  T  L  V  T  V  S  S    (SEQ ID NO: 378)
```

In an embodiment, this humanized VH sequence is recombinantly fused in-frame with a human heavy chain constant region and paired with a light chain for recombinant antibody production.

In another exemplary method to produce a humanized antibody comprising an ultralong CDR3, an ultralong CDR3 derived from BLV5B8 (SEQ ID NO: 7) is incorporated into the VH4-34 human acceptor framework (e.g., 4-34*02 (SEQ ID NO: 33); or 4-34*09 (SEQ ID NO: 34), along with a portion of the human JH2 region to produce a humanized antibody comprising an ultralong CDR3. Next, the nucleotides encoding the last two amino acid residues of the VH4-34 human acceptor framework (e.g., "AR") are removed from the VH4-34 human acceptor framework, and nucleotides encoding a "TTVHQ" motif are added to the 3' end of the VH4-34 human acceptor framework after the nucleotides that code for the second conserved cysteine residue in the VH4-34 human acceptor framework (e.g., after the nucleotides that code for amino acid position 95 of SEQ ID NOS: 33 or 34). Finally, DNA encoding a partial human JH2 region, beginning with the conserved tryptophan residue common to J region sequences, is added to the 3' end of the portion of the ultralong CDR3 sequence derived from BLV5B8. Thus, the following sequence encoding a humanized antibody variable region comprising an ultralong CDR3 is produced:

```
                                            (SEQ ID NO: 379)
caggtgcagctacaacagtggggcgcaggactgttgaagccttcggagac cctgtccctcacctgcgctgtctatggtgggtccttcagtggttactact ggagctggatccgccagccccagggaaggggctggagtggattggggaa atcaatcatagtggaagcaccaactacaacccgtccctcaagagtcgagt caccatatcagtagacacgtccaagaaccagttctccctgaagctgagct ctgtgaccgccgcggacacggctgtgtattactgtActactgtgcaccag
GAAACCAGAAAAACCTGTTCTGATGGTTATATGGCTGTAGATAGTTGTGG
TCGTGGTCAGAGTGATGGTTGTGTCAATGATTGCAATTGTTGTTATTATG
GTTGGCGGAACTGTCGCAGGCAGCCTGCAATTCAAAGTTACGAATTTCAC
GTCGATGCCTGGGGCCGTGGCACCCTGGTCACTGTCTCCTCAG
```
Regular Font - derived from human VH4-39

Underlined - derived from VH-UL

BOLD BLACK - ultralong CDR3, derived from cow BLVH 12

ITALICS - derived from human JH2

The amino acid sequence as translated from this partially human variable region gene is:

```
caggtgcagctacaacagtggggcgcaggactgttgaagccttcggagaccctgtccctc
 Q  V  Q  L  Q  Q  W  G  A  G  L  L  K  P  S  E  T  L  S  L acctgcgctgtctatggtgggtccttcagtggttactactggagctggatccgccagccc
 T  C  A  V  Y  G  G  S  F  S  G  Y  Y  W  S  W  I  R  Q  P ccagggaaggggctggagtggattggggaaatcaatcatagtggaagcaccaactacaac
 P  G  K  G  L  E  W  I  G  E  I  N  H  S  G  S  T  N  Y  N ccgtccctcaagagtcgagtcaccatatcagtagacacgtccaagaaccagttctccctg
 P  S  L  K  S  R  V  T  I  S  V  D  T  S  K  N  Q  F  S  L aagctgagctctgtgaccgccgcggacacggctgtgtattactgtactactgtgcaccag
 K  L  S  S  V  T  A  A  D  T  A  V  Y  Y  C  T  T  V  H  Q gaaaccagaaaaacctgttctgatggttatatggctgtagatagttgtggtcgtggtcag
 E  T  R  K  T  C  S  D  G  Y  M  A  V  D  S  C  G  R  G  Q agtgatggttgtgtcaatgattgcaattgttgttattatggttggcggaactgtcgcagg
 S  D  G  C  V  N  D  C  N  C  C  Y  Y  G  W  R  N  C  R  R cagcctgcaattcaaagttacgaatttcacgtcgatgcctggggccgtggcaccctggtc
 Q  P  A  I  Q  S  Y  E  F  H  V  D  A  W  G  R  G  T  L  V Actgtctcctcag  (SEQ ID NO: 379)
 T  V  S  S    (SEQ ID NO: 380)
```

In an embodiment, this humanized VH sequence is then recombinantly fused in-frame with a human heavy chain constant region and paired with a light chain for recombinant antibody production.

The library of amplified antibody variable regions were then subjected to deep sequencing. Briefly, bar-coded primers (Table 1) for each of the three cows (MID 1, MID 10, and MID 11) were used to amplify $V_H$ from bovine spleen cDNA.

TABLE 1

Bar-coded primers for deep sequencing

| Primer # | Isotype | Primers |
|---|---|---|
| MID1 FW | IgG | CCTATCCCCTGTGTGCCTTGGCAGTCTCAGACGAGTGCGTTTGAGCGACA AGGCTGTAGGCTG (SEQ ID NO: 381) |
| MID1 RV | IgG | CCATCTCATCCCTGCGTGTCTCCGACTCAGACGAGTGCGTCTTTCGGGGC TGTGGTGGAGGC (SEQ ID NO: 382) |
| MID10 FW | IgM | CCTATCCCCTGTGTGCCTTGGCAGTCTCAGTCTCTATGCGTTGAGCGACA AGGCTGTAGGCTG (SEQ ID NO: 383) |
| MID10 RV | IgM | CCATCTCATCCCTGCGTGTCTCCGACTCAGTCTCTATGCGAGTGAAGACT CTCGGGTGTGATTCAC (SEQ ID NO: 384) |
| MID11 FW | IgM | CCTATCCCCTGTGTGCCTTGGCAGTCTCAGTGATACGTCTTTGAGCGACA AGGCTGTAGGCTG (SEQ ID NO: 385) |
| MID11 RV | IgM | CCATCTCATCCCTGCGTGTCTCCGACTCAGTGATACGTCTAGTGAAGACTC TCGGGTGTGATTCAC (SEQ ID NO: 386) |

Thus, any heavy chain variable region can be paired with a light chain variable region to produce a recombinant antibody. Bovine antibodies containing ultralong VH CDR3s typically pair with a restricted set of lambda light chains. Several human VL sequences can be used to pair with the sequences above, including VL1-47, VL1-40, VL1-51, VL2-18, which are homologous to the lambda region derived from Bos taurus.

Example 2

Libraries of polynucleotides encoding antibodies that comprise an ultralong CDR3 may be constructed by any method known in the art. Such polynucleotide libraries may be present within a plurality of vectors (e.g., a library of vectors) including, for example, vectors present within a plurality of host cells (e.g., a library of host cells). The libraries may present in any known format including, in a spatially addressed format (see, e.g., WO 11/056997; and Mao et al. (2010) Nat Biotech 28:1195-1202).

In an exemplary method, bovine spleen and lymph nodes were obtained from Animal Technologies (Tyler, Tex.), or from Texas A&M University. Total RNA was isolated from bovine tissues from three different cows (MID 1, MID 10, and MID 11) using TRIzol reagent (Invitrogen, Carlsbad, Calif., USA) followed by on column digestion of DNA using the RNeasy Mini Kit (Qiagen, Valencia, Calif., USA). Alternatively, cDNA may be obtained from the lymph nodes of a bovine immunized with an antigen (e.g., BVDV). Next, RNA quantity and quality were assessed with Nanodrop (Thermal Scientific), Qubit RNA and Agilent 2100 Bioanalyzer (Agilent, Santa Clara, Calif., USA), following the manufacturer's protocols. Total RNA was used as a template for cDNA synthesis catalyzed by Superscript II (Invitrogen).

Next, the amplicons of $V_H$ were purified from 2% agarose gels and deep sequenced according to Roche 454 GS FLX instructions. Multiple alignments were performed with the MUSCLE algorithm (Edgar (2004) Nucleic Acids Research 32:1792-1797). MUSCLE was executed to generate multiple long CDR H3 nucleotide alignments with relatively high gap open (−20.0) and gap extend (−10.0) penalties due to the large amount of heterogeneity observed in the sequences. Local alignment was executed using the Smith-Waterman algorithm with the following settings, match score=2.0, mismatch penalty=−1.0, gap opening penalty=−2.0, and gap extension penalty=−0.5. CDR H3s were defined by the third residue following the conserved cysteine in framework 3 to the residue immediately preceding the conserved tryptophan in framework 4. $V_H$BUL was identified by BLAST searching the bovine genome (assembly Btau_4.6.1) with multiple ultralong VH sequences identified by deep sequencing. The deep sequencing identified a total of 11,728 ultralong CDR3 sequences with having a length between 44 and 69 amino acid residues. The results of the deep sequencing are summarized in Table 2 below.

TABLE 2

Summary of deep sequencing results from bovine spleen

| Source (Bar code) | Cow#1 (MID1) | Cow#1 (MID10) | Cow#2 (MID11) |
|---|---|---|---|
| Ig Class | IgG | IgM | IgM |
| CDR H3 length range | 44-66 | 44-68 | 44-69 |
| Number of unique cysteine patterns | 655 | 449 | 847 |
| Total number of unique long CDR H3 sequences | 5633 | 1639 | 4456 |

The results of the deep sequencing also revealed that ultralong CDR3 comprise a cysteine motif (e.g., a pattern of cysteine residues) that comprises between 3 and 12 cysteine residues. Representative examples of cysteine patterns are shown for the deep sequencing run for three different cows (MID1, MID10, and MID 11) as well as their abundance in the run (Tables 3-5). The cysteines in the ultralong CDR3 regions are symbolized as "C". The amino acids between two cysteines are symbolized as "$X_n$". Exemplary sequences comprising cysteine motifs identified from the deep sequencing are presented in FIGS. 2A-C.

TABLE 3

Cysteine patterns identified in ultralong CDR3s from MID1

| Cysteine pattern (MID1) | Abundance (%) |
|---|---|
| $CX_{10}CX_5CX_5CXCX_7C$ | 10.44% |
| $CX_{10}CX_6CX_5CXCX_{15}C$ | 8.11% |
| $CX_{11}CXCX_5C$ | 5.22% |
| $CX_{11}CX_5CX_5CXCX_7C$ | 2.56% |
| $CX_{10}CX_6CX_5CXCX_{13}C$ | 1.47% |
| $CX_{10}CX_5CXCX_4CX_8C$ | 1.19% |
| $CX_{10}CX_6CX_6CXCX_7C$ | 1.08% |
| $CX_{10}CX_4CX_7CXCX_8C$ | 1.05% |
| $CX_{10}CX_4CX_7CXCX_7C$ | 0.91% |
| $CX_{13}CX_8CX_8C$ | 0.91% |
| $CX_{10}CX_6CX_5CXCX_7C$ | 0.59% |
| $CX_{10}CX_5CX_5C$ | 0.57% |
| $CX_{10}CX_5CX_6CXCX_7C$ | 0.50% |
| $CX_{10}CX_6CX_5CX_7CX_9C$ | 0.43% |
| $CX_9CX_7CX_5CXCX_7C$ | 0.41% |
| $CX_{10}CX_6CX_5CXCX_9C$ | 0.36% |
| $CX_{10}CXCX_4CX_5CX_{11}C$ | 0.32% |
| $CX_7CX_3CX_6CX_5CXCX_5CX_{10}C$ | 0.32% |
| $CX_{10}CXCX_4CX_5CXCX_2CX_3C$ | 0.30% |
| $CX_{16}CX_5CXC$ | 0.23% |

TABLE 4

Cysteine patterns identified in ultralong CDR3s from MID10

| Cysteine pattern (MID10) | Abundance (%) |
|---|---|
| $CX_{10}CXCX_4CX_5CXCX_2CX_3C$ | 2.87% |
| $CX_{10}CX_5CX_5C$ | 0.73% |
| $CX_{10}CXCX_4CX_5CX_{11}C$ | 0.67% |
| $CX_6CX_4CXCX_4CX_5C$ | 0.61% |
| $CX_{11}CX_4CX_5CX_6CX_3C$ | 0.55% |
| $CX_8CX_2CX_6CX_5C$ | 0.43% |
| $CX_{10}CX_5CX_5CXCX_{10}C$ | 0.37% |
| $CX_{10}CXCX_6CX_4CXC$ | 0.31% |

TABLE 4-continued

Cysteine patterns identified in ultralong CDR3s from MID10

| Cysteine pattern (MID10) | Abundance (%) |
|---|---|
| $CX_{10}CX_5CX_5CXCX_2C$ | 0.31% |
| $CX_{14}CX_2CX_3CXCXC$ | 0.31% |
| $CX_{15}CX_5CXC$ | 0.31% |
| $CX_4CX_6CX_9CX_2CX_{11}C$ | 0.31% |
| $CX_6CX_4CX_5CX_5CX_{12}C$ | 0.31% |
| $CX_7CX_3CXCXCX_4CX_5CX_9C$ | 0.31% |
| $CX_{10}CX_6CX_5C$ | 0.24% |
| $CX_7CX_3CX_5CX_5CX_9C$ | 0.24% |
| $CX_7CX_5CXCX_2C$ | 0.24% |
| $CX_{10}CXCX_6C$ | 0.18% |
| $CX_{10}CX_3CX_3CX_5CX_7CXCX_6C$ | 0.18% |
| $CX_{10}CX_4CX_5CX_{12}CX_2C$ | 0.18% |

TABLE 5

Cysteine patterns identified in ultralong CDR3s from MID11

| Cysteine pattern (MID11) | Abundance (%) |
|---|---|
| $CX_{12}CX_4CX_5CXCXCX_9CX_3C$ | 1.19% |
| $CX_{12}CX_4CX_5CX_{12}CX_2C$ | 0.96% |
| $CX_{10}CX_6CX_5CXCX_{11}C$ | 0.92% |
| $CX_{16}CX_5CXCXCX_{14}C$ | 0.70% |
| $CX_{10}CX_5CXCX_8CX_6C$ | 0.52% |
| $CX_{12}CX_4CX_5CX_8CX_2C$ | 0.49% |
| $CX_{12}CX_5CX_5CXCX_8C$ | 0.47% |
| $CX_{10}CX_6CX_5CXCX_4CXCX_9C$ | 0.45% |
| $CX_{11}CX_4CX_5CX_8CX_2C$ | 0.45% |
| $CX_{10}CX_6CX_5CX_8CX_2C$ | 0.43% |
| $CX_{10}CX_6CX_5CXCX_8C$ | 0.36% |
| $CX_{10}CX_6CX_5C$ | 0.31% |
| $CX_{10}CX_6CX_5CXCX_3CX_8CX_2C$ | 0.29% |
| $CX_{10}CX_6CX_5CX_3CX_8C$ | 0.29% |
| $CX_{10}CX_6CX_5CXCX_2CX_6CX_5C$ | 0.25% |
| $CX_7CX_6CX_3CX_3CX_9C$ | 0.25% |
| $CX_9CX_8CX_5CX_6CX_5C$ | 0.22% |
| $CX_{10}CX_2CX_2CX_7CXCX_{11}CX_5C$ | 0.20% |
| $CX_{10}CX_6CX_5CXCX_{13}C$ | 0.20% |
| $CX_{10}CX_6CX_5CXCX_2CX_8CX_4C$ | 0.20% |

Bovine V$_H$ regions were amplified from cDNA prepared in example 9 using primers 5'-TTGAGCGACAAGGCTG-TAGGCTG-3' (SEQ ID NO: 387) and 5'-CTTTCGGGGCT-GTGGTGG-AGGC-3' (SEQ ID NO: 388) producing a library of antibody variable region cDNA biased for ultralong CDRs. Next, the mixture of V$_H$ regions was assembled by overlap PCR with bovine CH1 and human IgG Fc. Briefly, EcoRI and NheI sites were incorporated for ligation into pFUSE expression vector, to afford a full-length heavy chain library ready for expression in mammalian cells. The ligation product was transformed into E. coli and 500 single E. coli transformants were picked. Each transformant was then grown overnight in a separate vessel and DNA from each colony was extracted using Qiagen minprep kits (Qiagen, Inc.) and sequenced by BATJ, Inc. (San Diego, Calif.) using the oligo 5'-AGATCCAAGCTGTGACCGGC-3' (SEQ ID NO: 389). Sequences were analyzed using VectorNTI (Invitrogen, Inc. Carlsbad, Calif.). Duplicative sequences, sequences with no insert, and sequences encoding a CDR shorter than 35 residues were excluded. 132 clones containing unique long CDR heavy chain sequences were selected. Each heavy chain in the 132 member library was then co-transfected in parallel with pFUSE expression vector encoding the invariant bovine light chain BLV1H12 (SEQ ID NO: 412) into 293T cells, to generate a small spatially addressed library (Mao et al. (2010) Nat Biotech 28:1195-1202). 130,000 293T cells per well were plated in 24 well plates and grown overnight in 500 ul DMEM media (Invitrogen) with 10% FBS (Invitrogen), and Penicillin/streptomycin/glutamine (Invitrogen) at 37° C. and 5% CO$_2$. 0.5 µg of Hc-encoding pFuse vector and 0.5 g of Lc-encoding pFuse vector were added to 25 µl of optimem (Invitrogen). 1 µl of Lipofectamine 2000 or 293Fectin transfection reagent (Invitrogen) was added to 25 µl of optimem, and incubated 5 minutes. Next, the DNA-optimem mix and transfection reagent-optimem mix were combined and incubated 15 minutes, added to 293T cells, and allowed to incubate on cells 4-6 hours. Then media was aspirated from wells and replaced with fresh media, and cells were allowed to grow and secrete IgG into the media for 4 days. Cell-culture supernatants containing IgG were harvested in 96 well format for further testing. The chimeric antibodies were quantified by sandwich ELISA detecting human F$_c$ and screened for binding to BVDV by ELISA.

Antibodies were then secreted into culture media and harvested in a 96 well format to generate a small spatially addressed library for further testing including, screening for binding to BVDV by ELISA. For example, an ELISA was conducted to screen the antibody library for binding to BVDV. Briefly, killed BVDV (0.2 µg) in 100 µL DPBS was coated on 96-well MaxiSorp ELISA plates (Nunc) for 1 hour at 37° C. Next, the plates were blocked with 200 µL 3% BSA solution in DPBST, Dulbecco's phosphate buffered saline, 0.25% Tween 20) for 1 hour at 37° C. Samples were then incubated with 3% BSA in DPBST for 1 hour at 37° C. Subsequently, wells were washed 5 times with 200 µL DPBST. Next, Goat Anti-Human IgG (Fc)-HRP conjugated antibody (KPL Inc.) was added at a 1:1,000 dilution in blocking solution and incubated for 1 hour at 37° C. Wells were then washed 10 times with 200 µL DPBST. A 100 µL working solution of QuantaBlu (Pierce) was added to each well and incubated for 5 minutes at room temperature before plates were read in a SpectraMax M5 plate reader at ex325/em420 nm. Several candidate binders were identified. Clone H12 has a 63-residue CDR3 with 6 cysteine residues and was able to strongly bind BVDV in a dose dependent fashion.

Additionally, binding of the chimeric recombinant antibodies to BVDV antigens was evaluated by immunocytometric analysis of transfected human embryonic kidney (HEK) 293A cells (Invitrogen), as previously described (see, e.g., Njongmeta et al. (2012) Vaccine 30:1624-1635). Briefly, HEK 293A monolayers grown in 6-well tissue culture plates were transfected with 2 gig/well of plasmid (pCDNA3.3, Invitrogen) encoding BVDV antigens (N$^{pro}$, E2, or non-structural proteins NS2-3) using Lipofectamine 2000 reagent (Invitrogen), and incubated for 48 hr at 37° C. with 5% CO$_2$. The monolayers were fixed with ice-cold 100% methanol for 10 minutes, rinsed with PBS, and after blocking for 1 hour with PBS containing 5% fetal bovine serum (blocking buffer), the monolayers were incubated at room temperature for 1 hr with 10 µg/ml of a mouse anti-FLAG M2-alkaline phosphatase (AP)-conjugate (Sigma) in blocking buffer or 10 µg/ml of the chimeric recombinant antibodies (H12 or B8). Monolayers transfected with empty vector were similarly reacted to serve as negative controls and, following washes in blocking buffer, the monolayers probed with the chimeric recombinant antibodies were incubated with a 1/200 dilution of AP-conjugated goat anti-Human IgG (Fc specific) mAb (Sigma) in blocking buffer for 1 hr. Following washes in blocking buffer, the AP activity in all the wells was detected using Fast Red AS-MX substrate (Sigma). Stained cells were visualized and photographed using an IS70 inverted optical microscope (Olympus, Japan) equipped with a camera. H12 strongly binds HEK293A cells transfected with the NS2-3 non-structural proteins of BVDV but weakly bound to untransfected cells while B8 had weak binding to both HEK293A cells transfected with the NS2-3 non-structural proteins of BVDV and untransfected cells.

Example 3

Any vector known in the art may be used, or may be modified to be used, for cloning and/or expression of a nucleotide sequence encoding a heavy chain variable region that comprises an ultralong CDR3. Such vectors may optionally comprise, or be modified to comprise, a nucleotide sequence encoding the Fc portion of a human immunoglobulin (e.g., IgG) linked to the nucleotide sequence encoding the heavy chain variable region comprising an ultralong CDR3. Additionally, the nucleotide sequence encoding the heavy chain variable region comprising the ultralong CDR3 may be modified according to known methods such that the ultralong CDR3 can accept a nucleotide sequence encoding a non-bovine (e.g., non-antibody or human) sequence including, for example, by unidirectional cloning with restriction enzymes. Any vector known in the art may also be used, or may be modified to be used, for cloning and/or expression of a nucleotide sequence encoding a light chain variable region.

In an exemplary method, a vector may be modified by recombinant techniques to comprise a nucleotide sequence encoding a heavy chain variable region having an ultralong CDR3 linked to a nucleotide sequence encoding an IgG Fc. Briefly, a nucleotide sequence encoding CH1-CH2-CH3 of human IgG1 (SEQ ID NO: 390) was amplified by PCR and assembled via strand overlap elongation. Next, a compatible cohesive-end strategy was employed to replace the human Fc sequence encoded in vector pFUSE-hIgG2-Fc2 (SEQ ID NO: 457, InVivogen, San Diego Calif.) with CH1-CH2-CH3 of human IgG1, which destroyed the existing 3' NheI site in the pFUSE-hIgG2-Fc2 vector and generated an NheI site at the 5' end of SEQ ID NO: 390. The modified pFUSE-hIgG2-

Fc2 vector ("HC pFuse", SEQ ID NO: 458) allows insertion of VH fragments between the signal sequence and the nucleotide sequence encoding CH1-CH2-CH3 of human IgG1 using the existing EcoRI site and the newly introduced NheI site. For example, the VH region from bovine antibody BLV1H12 (SEQ ID NO: 392) was amplified by PCR and subcloned in-frame between the signal sequence and nucleotide sequence encoding CH1-CH2-CH3 of human IgG1 in the HC pFuse vector using EcoRI and NheI restriction enzymes generating SEQ ID NO: 393.

Alternatively, nucleotide sequences encoding non-bovine sequences were inserted into the nucleotide sequence encoding the CDR3 of BLV1H12 heavy chain. Briefly, a pair of BsaI sites were introduced by PCR strand overlap extension into the nucleotide sequence encoding the CDR3 of BLV1H12 (SEQ ID NO: 395). The modified nucleotide sequence incorporating the BsaI sites within the CDR3 encoding sequence of BLV1H12 was then subcloned in-frame between the signal sequence and the nucleotide sequence encoding CH1-CH2-CH3 of human IgG1 in the HC pFuse vector described above using EcoRI and NheI restriction enzymes. Next, non-antibody sequences including cDNA encoding for interleukin 8 (IL-8, SEQ ID NO: 475), interleukin 21 (IL-21, SEQ ID NO: 480) and CXCL12/SDF-1alpha (SEQ ID NO: 479) (Origene) and oligoprimers encoding the peptide hormone somatostain (SEQ ID NO: 477), the venom peptides ProTx-II (SEQ ID NO: 481) and chlorotoxin (SEQ ID NO: 478), and the synthetic conotoxin peptide ziconotide (SEQ ID NO: 476) (IDTDNA) were modified by PCR amplification using oligoprimers with BsaI flanks to comprise BsaI flanks to produce non-bovine sequences with BsaI flanks for insertion into the CDR3 of BLV1H12. Next, the BsaI flanks in the modified non-antibody sequences were cut with BsaI and ligated, in frame, with the BLV1H12 BsaI digested vector, thereby inserting the nucleotide sequence encoding the non-antibody sequence into the BLV1H12 heavy chain variable region and replacing a portion (e.g., cysteine-rich portion) of the ultralong CDR3, and in-frame with the sequence encoding BVL1H12 variable region and CH1-CH2-CH3.

Similarly, a vector was modified by recombinant techniques to comprise a nucleotide sequence encoding a light chain. Briefly, the BLV1H12 light chain sequence (SEQ ID NO: 412) was amplified by PCR to introduce EcoRI and NheI ends. The BLV1H12 light chain variable region sequence was then digested with EcoRI and NheI and subcloned into pFUSE-hIgG2-Fc2, deleting the portion of pFUSE-hIgG2-Fc2 encoding Fc, and replacing it with only light chain sequence (SEQ ID NO: 459).

In addition, overlap PCR was used to amplify and join sequence from BLV1H12 light chain variable region and human lambda light chain constant region (SEQ ID NO: 474). This was amplified by PCR to introduce EcoRI and NheI ends. The hybrid BLV1H12 with human lambda sequence was then digested with EcoRI and NheI and subcloned into pFUSE-hIgG2-Fc2, deleting the portion of pFUSE-hIgG2-Fc2 encoding Fc, and replacing it with only light chain sequence.

Example 4

Polynucleotides coding for antibodies comprising an ultralong CDR3 may be expressed including, transiently expressed, in a host cell by any method known in the art.

In an exemplary method, the vectors comprising the heavy and light chains generated in Example 2 may be transfected into human embryonic kidney (HEK) 293 cells, for example, 293T cells or Freestyle™ 293-F cells.

For example, 130,000 293T cells per well were plated in 24 well plates and grown overnight in 500 d DMEM media (Invitrogen) with 10% FBS (Invitrogen), and penicillin/streptomycin/glutamine (Invitrogen) at 37° C. and 5% $CO_2$. Next, 0.5 μg of Heavy chain-encoding pFuse vector (e.g., generated in Example 2) and 0.5 μg of Light chain-encoding pFuse vector (e.g., generated in Example 2) were added to 25 μl of Opti-MEM (Invitrogen). Subsequently, 1 μl of Lipofectamine 2000 or 293Fectin transfection reagent (Invitrogen) was added to 25 μl of Opti-MEM, and incubated 5 minutes. Then the dna-Opti-MEM solution and transfection reagent-Opti-MEM solution were combined and incubated for 15 minutes, added to 293T cells, and allowed to incubate on cells for 4-6 hours. Then media was aspirated from wells and replaced with fresh media, and the cells were allowed to grow and secrete IgG into the media for 2-6 days.

Additionally, for example, $1\times10^6$ 293Freestyle suspension cells/ml were grown overnight in Freestyle™293 Expression Medium (Invitrogen), and penicillin/streptomycin/glutamine (Invitrogen) at 37° C. and 5% $CO_2$. Next, for each milliliter of cells, a 301 solution was made in buffer PBS comprising 0.5 μg Heavy chain-encoding pFuse DNA and 0.5 μg of Lc-encoding pFuse. Additionally, for each milliliter of cells, a solution comprising 1 μl of 293Fectin transfection reagent was added to 30 μl PBS and incubated 5 minutes. Subsequently, the DNA and lipofectamine solutions were combined and incubated 15 minutes before adding the mixture to the cells. The cells were then allowed to grow and secrete IgG into media for 2-6 days.

After the growth period for the 293T cells or Freestyle™ 293-F suspension cells, media was harvested, and IgG secreted into the supernatant was evaluated by sandwich ELISA. Briefly, Fc-specific anti Human IgG (Cat 12136, Sigma-Aldrich) was diluted 1:1000 in PBS and coated onto maxisorp plates (Nunc). Next, plates were blocked with 2% BSA in TBST, washed, and IgG secreted supernatants were incubated for 1 hour. After washing with TBST, the appropriate HRP conjugated anti-Light chain antibody is diluted 1:1000 in TBST and incubated 1 hour (anti kappa-HRP, Cat # A-7164, Sigma-Aldrich; anti-lambda-HRP, Cat #2070-05, Southern Biotech). After washing with TBST, HRP was detected with TMB (Cat # TMBS-1000-01, BioFX), and neutralized with 0.6M $H_2SO_4$. Subsequently, absorbance (A450) was measured, and compared to a standard curve of known IgG concentration to determine the concentration of human antibody in cell culture supernatant.

The yield of antibody from supernatants from cells transfected with heavy chain constructs encoding BLV1H12 with human CH1-CH2-CH3 and a replacement of at least a portion of CDR3 (generated in Example 3) and a light chain construct encoding BLV1H12 LV-human lambda LC was determined by ELISA, and normalized to the yield of BLV1H12-IL8 (Table 6). The ELISA indicated that some sequences (e.g., zinconotide) that were used to replace a portion of CDR3 have a minor impact on expression of the antibody, while some sequences (e.g., somatostatin, chlorotoxin, SDF (alpha), IL21) that were used to replace a portion of CDR3 had a modest impact on expression of the antibody, and other sequences (ProTxII) had an even greater impact on expression of the antibody, as compared to BLV1H12-IL8 (the highest expressor) (Table 6).

TABLE 6

Expression yield of BLV1H12 with replacements to Long CDR3

| Heavy Chain V region | Light Chain | Normalized Yield (% of highest expressor) |
|---|---|---|
| BLV1H12-IL8 | BLV1H12-HuLambdaC | 100 |
| BLV1H12-Ziconotide | BLV1H12-HuLambdaC | 94.7 |
| BLV1H12-Somatostatin | BLV1H12-HuLambdaC | 46.5 |
| BLV1H12-Chlorotoxin | BLV1H12-HuLambdaC | 39.7 |
| BLV1H12-SDF1(alpha) | BLV1H12-HuLambdaC | 38.9 |
| BLV1H12-IL21 | BLV1H12-HuLambdaC | 32.3 |
| BLV1H12-ProTxII | BLV1H12-HuLambdaC | 2.1 |

Example 5

Human germline sequences that comprise an ultralong CDR3 may be evaluated by any method known in the art to identify those human germline sequences that permit expression of an ultralong CDR3 that comprises a non-bovine sequence.

In an exemplary method, overlap PCR was used to insert BsaI sites into human germline variable regions VH1-24, VH1-46, VH1-69, VH3-23, VH4-4, and VH4-34.

Next, PCR was used to introduce EcoRI and NheI sites for sub-cloning in between the signal sequence and CH1-CH2-CH3 region of the HC pFuse vector comprising BLV1H12 generated in Example 2. Subsequently, the IL-8-GSG cassette (SEQ ID NO: 399) was introduced into the BsaI sites of each human germline construct, giving VH1-24+CDR3-IL8 (SEQ ID NO: 425), VH1-46+CDR3-IL8 (SEQ ID NO: 426), VH1-69+CDR3-IL8 (SEQ ID NO: 427), VH3-23+CDR3-IL8 (SEQ ID NO: 428), VH4-4+CDR3-IL8 (SEQ ID NO: 429), and VH4-34+CDR3-IL8 (SEQ ID NO: 430). Next, each pFuse vector encoding a human germline heavy chain and CDR3-IL8 construct was co-transfected with pFuse vector encoding BLV1H12 LV (SEQ ID NO: 474), and allowed to express and secrete these IgGs into the media as described in Example 4. ELISA was then used to determine IgG yield as described in Example 4. Yields of the constructs were determined, and normalized to the highest expressing construct. Surprisingly, the CDR3 from cow is not readily transposable to any human heavy chain variable region. VH4-4 had the highest yield, despite VH4-34 having the closest sequence homology to the BLV1H12 sequence (Table 7).

TABLE 7

| Expression Yield of Humanized Heavy Chains with Ultralong CDR3s (removed last column of values, with IgG nM, only showing normalized values. | |
|---|---|
| Heavy Chain Variable Region: | Normalized Yield (% of highest expressor) |
| BLV1H12 + CDR3IL8 | 100 |
| BLV1H12 | 58.4 |
| VH1-24 BLVCDR3IL8 | 4.4 |
| VH1-46 BLVCDR3IL8 | 2.4 |
| VH1-69 BLVCDR3IL8 | 1.4 |
| VH3-23 BLVCDR3IL8 | 14.7 |
| VH4-4 BLVCDR3IL8 | 22.5 |
| VH4-34 BLVCDR3IL8 | 5.4 |

Example 6

Antibodies comprising an ultralong CDR3 with a non-bovine sequence (e.g., a replacement of at least a portion of the CDR3 with a non-bovine sequence) including, humanized antibodies, may be evaluated by any method known in the art for binding of the non-bovine sequence to its binding partner including, for example, flow cytometry.

In an exemplary method, BLV1H12 IgG comprising a CDR3 with an IL-8 insert (e.g., the IL-8 sequence replaced a portion of the CDR3) was evaluated for binding to CXCR1 expressing cells by flow cytometry. Briefly, a cell line expressing functionally validated CXCR1 derived from U2OS cells was obtained from DiscoveRx and cultured per manufacturer's instructions (Cat #93-0226C3, DiscoveRx Corporation, Freemont, Calif.). The parental cell line U2OS was obtained from ATCC and cultured under the same conditions as the CXCR1 cells. Cell culture supernatants were then tested for binding to cells by flow cytometry. The adherent U2OS or CXCR1-U2OS cells were dissociated with Accutase (Innovative Cell Technologies, Inc., San Diego, Calif.), neutralized with an equal volume of media containing 10% serum, centrifuged at 1000 g, and resuspended in PBS with 2% BSA. Next, cells were dispensed into microtiter plates to achieve between 30,000 to 300,000 cells per well, centrifuged again, and resuspended in cell culture supernatant containing expressed IgG, or a dilution of IgG-containing cell culture supernatant. A fluorescent-conjugated anti-Human Fc antibody was used to detect binding of the expressed antibody to cells. Subsequently, cell fluorescence was measured by flow cytometry (e.g., FACS), and median Arbitrary Fluorescence Units (AFU) were calculated for each combination of antibody and cell type tested, revealing the extent of IgG binding to those cells. The ratio of median fluorescence (IgG binding) of CXCR1-U2OS cells versus U2OS parental cells shows that the BLV1H12 IgG comprising a CDR3 with an IL-8 insert has specificity for CXCR1 (Table 8).

TABLE 8

| Binding of BLV1H12 frameworks to CXCR1 U2OS cells | | |
|---|---|---|
| | ULcowV (Median Arbitrary Fluorescence Units (AFU)) | ULcowV + IL8 (Median Arbitrary Fluorescence Units (AFU)) |
| Parental U2OS | 4 | 76 |
| CXCR1-U2OS | 4 | 707 |

Additionally, the human germline CDR3-IL8 IgGs described in Example 5 were evaluated for binding to CXCR1 expressing cells by flow cytometry as described above. IgG binding to CXCR1-U2OS cells is indicated by higher fluorescence values, but non-specific binding to U2OS parental cells is also detectable. For a given IgG with CDR3-IL-8, specific binding to CXCR1 is revealed by the ratio of fluorescence on CXCR1-U2OS cells to the fluorescence on parental U2OS cells (Table 9). While the BLV1H12 supported strong and specific binding to CXCR1 (Table 8), the IL-8 in human germline IgGs showed either weaker binding to CXCR1, or non-specific interaction as seen in strong binding to both CXCR1-U2OS cells as well as the parental control cells. The most specific interaction to CXCR1 of IL-8 within a human germline IgG was seen with VH4-34.

TABLE 9

Binding of IgGs with CDR3-IL8 to CXCR1 U2OS cells

| IgG with HC V region: | Parental U2OS | CXCR1-U2OS | Ratio of CXCR1/Parental |
|---|---|---|---|
| BLV1H12 | 5 | 9 | 1.9 |
| VH1-24 + CDR3-IL8 | 5 | 23 | 4.3 |
| VH1-46 + CDR3-IL8 | 5 | 6 | 1.1 |
| VH1-69 + CDR3-IL8 | 20 | 78 | 4.0 |
| VH3-23 + CDR3-IL8 | 534 | 1443 | 2.7 |
| VH4-4 + CDR3-IL8 | 1007 | 3079 | 3.1 |
| VH4-34 + CDR3-IL8 | 70 | 648 | 9.3 |

In another exemplary method, IL-8 activation of the CXCR1 receptor was tested using the CXCR1-U2OS DiscoveRx cells described above (Cat #93-0226C3, DiscoveRx). The DiscoveRx cells are engineered such that upon activation by ligand, the resultant beta-arrestin recruitment to the GPCR also causes activation of a luminescent reporter enzyme present cell line. Lysis reagents and luminescence substrate are included in the PathHunter Detection Kit (Cat #93-001, DiscoveRx) which was used following manufacturer's instructions. U2OS-CXCR1 cells were plated at 15,000 cells per well and serum starved overnight in EMEM media without serum. Next, media was removed and cells were incubated 1 hour at 37° C. with 80 µl of 1:1 EMEM and PBS, containing dilutions of either IL-8 or IgG with IL-8 insertion in CDR3, or control antibody. After 1 hour, 40 µl of PathHunter Detection reagent mix was added. Subsequently, after an hour at room temperature the luminescence in each well was measured using a luminescence plate reader. Higher luminescence signal reveals more activation of the CXCR1 receptor at the tested concentrations of IL-8 or IgG. IgGs were purified by scaling up the transfection method of Example 4, and purification of the IgG from media using protein A sepharose following manufacturer's instructions (Cat #17-1279-03 GE Healthcare) and dialysis post-elution into PBS. Protein yield was determined by A280 and calculated molar extinction coefficient. Increasing concentrations of BLV1H12-IL8 IgG activated CXCR1 somewhat similarly to the activation observed with IL-8, whereas increasing concentration of BLV1H12 IgG had no effect on CXCR1 activation (Table 10).

TABLE 10

Activation of CXCR1 by IL-8 as soluble cytokine or as CDR3 replacement

| nM | IL-8 (average RLU) | BLV1H12-IL8 IgG (average RLU) | IgG_BVL1H12 IgG (average RLU) |
|---|---|---|---|
| 500.00 | 5720 | 6641 | 484 |
| 166.67 | 6770 | 6207 | 525 |
| 55.56 | 7365 | 5509 | 511 |
| 18.52 | 7295 | 5071 | 529 |
| 6.17 | 5869 | 4428 | 517 |
| 2.06 | 4110 | 3645 | 495 |
| 0.69 | 1939 | 2651 | 516 |
| 0.23 | 940 | 1515 | 455 |
| 0.08 | 504 | 822 | 461 |
| 0.01 | 440 | 435 | 460 |

Additionally, antibodies in which IL-8 was grafted into the VH4-4 human germline variable region were tested for activation of CXCR1. IgG with VH4-4+CDR3-IL8 (SEQ ID NO: 429) was compared to BLV1H12+CDR3-IL8, and IgGVH4-4 CDR3 BsaI (lacking the IL-8 insert) (SEQ ID NO: 431). A single concentration of soluble IL-8 was tested as a positive control for assay function at 31.5 nM and gave activation of 55525 average RLU. (Table 11). Although the IgG with insertion of IL-8 into the human VH4-4 variable region did activate CXCR1, it was not as potent in equal dose to the IgG with BLV1H12 sequence.

TABLE 11

Activation of CXCR1 by IgGs with CDR3 IL-8

| IgG (nM) | BLV1H12 + CDR3-IL8 (average RLU) | VH4-4 + CDR3-IL8 (average RLU) | VH4-4 + CDR3-BsaI (average RLU) |
|---|---|---|---|
| 261.500 | 56349 | 36481 | 7545 |
| 87.167 | 52128 | 29623 | 7139 |
| 29.056 | 47621 | 24889 | 7104 |
| 9.685 | 39280 | 15545 | 7174 |
| 3.228 | 34544 | 10233 | 7034 |
| 1.076 | 23700 | 8012 | 7184 |
| 0.359 | 13278 | 7338 | 6687 |
| 0.120 | 8867 | 7513 | 7331 |
| 0.040 | 7736 | 7323 | 6973 |
| 0.013 | 7329 | 6956 | 7048 |
| 0.004 | 7240 | 7067 | 7387 |
| 0.001 | 7437 | 7142 | 7500 |

Example 7

Humanized antibodies generated in Example 5 may be modified to comprise one or more amino acid substitutions in heavy chain CDR1 and/or CDR2. Such amino acid substitutions may be introduced into a human germline CDR1 and CDR2 at positions that are hypothesized to interact with CDR3.

In an exemplary method, certain residues in VH4-34 CDR1 and/or CDR2 were substituted with corresponding CDR1 and/or CDR2 residues from BLV1H12. Briefly, the pFuse vector encoding heavy chain VH4-34 CDR3-IL8 was modified by overlap PCR to replace all of CDR1 with sequence from BLV1H12 (VH4-34+CDR3-IL8_CDR1 Cow, SEQ ID NO: 432) or all of CDR2 with sequence from BLV1H12 (VH4-34+CDR3-IL8_CDR2 Cow, SEQ ID NO: 433). Additionally, overlap PCR was used to introduce point mutants G31D and Y32K into CDR1 (VH4-34+CDR3-IL8_CDR1 G31D, Y32K, SEQ ID NO: 434) or point mutant E50S into CDR2 (VH4-34+CDR3-IL8_CDR2 E50S, SEQ ID NO: 435). These heavy chain constructs were paired with BLV1H12 light chain and were expressed as described in Example 4. Yield and CXCR1 binding were determined as described in Example 6 (Table 12).

TABLE 12

CDR1 and 2 modification of VH4-34 CDR3-IL8 IgG

| Heavy chain | IgG Yield normalized | FACS CXCR1/ Parental Ratio |
|---|---|---|
| BLV1H12 | 100 | 1.9 |
| VH4-34 + CDR3-IL8 | 20 | 9.3 |
| VH4-34 + CDR3-IL8 + Cow CDR1 | 29 | 2.1 |
| VH4-34 + CDR3-IL8 + Cow CDR2 | 9 | 8.0 |
| VH4-34 + CDR3-IL8 + E31D, Y32K | 19 | 8.1 |
| VH4-34 + CDR3-IL8 + E50S | 27 | 4.0 |

Example 8

Antibodies that comprise an ultralong CDR3 including, antibodies that comprise an ultralong CDR3 where at least a portion of the CDR3 has been replaced by a non-bovine sequence, may be paired with a human light chain.

In an exemplary method, BLV1H12+CDR3-IL8 flexibility to pair productively with human germline light chains was explored by co-transfecting pFuse vector encoding heavy chain BLV1H12+CDR3-IL8 with pFuse vectors encoding each of several human germline light chains (e.g., SEQ ID NOs: 445-456), or BLV1H12 light chain (SEQ ID NO: 412). These human germline light chain sequences were synthesized (Genscript, Inc) and amplified by PCR as in Example 3 for subcloning via EcoRI and NheI into the pFUSE LC vector. BLV1H12+CDR3-IL8 encoding pFUSE vector was cotransfected with pFUSE vectors encoding light chains as in Example 3. Secreted IgGs were then tested by FACS as in Example 5 for specific binding to CXCR1 cells (Table 13). Human germ line light chains did not readily support the function of IL-8 when expressed as BLV1H12+CDR3.

TABLE 13

Evaluation of BLV1H12 + CDR3-IL8 when paired with germline human light chains

| Light chain | FACS CXCR1/Parental Ratio |
|---|---|
| A20J1 | 0.8 |
| A27J3 | 0.9 |
| L6J1 | 0.8 |
| L25J1 | 1.3 |
| V1-2J7 | 0.8 |
| V1-7J1 | 0.6 |
| V1-11J2 | 0.8 |
| V1-13J5 | 2.9 |
| V1-16J6 | 0.6 |
| V2-13J2 | 0.9 |
| V2-14J4 | 1.0 |
| V2-15J7 | 1.1 |
| V2-17J2 | 2.0 |
| V3-4J1 | 1.2 |
| V5-4J2 | 0.8 |
| BLV1H12 | 5.0 |

Alternatively, using the BLV1H12 light chain variable region as a guide, the human germline sequences identified with closest homology were V 1-47 and V 1-51. These light chain sequences were synthesized (SEQ ID NO: 455, 456) (IDTDNA, Inc.) with the desired EcoRI and NheI restriction sites for subcloning into the pFuse vector. Subsequently, pFuse vector encoding V1-47 or V 1-51 were paired with pFuse vectors encoding VH4-34+CDR3-IL8, the VH4-34+CDR3-IL8 with the CDR1 or CDR2 modifications described in Example 6 (SEQ ID NOs: 432-435), as well as vectors encoding the combinations of both CDR1 and CDR2 modifications (e.g., VH4-34+CDR3-IL8_CDR1 Cow_CDR2 Cow, SEQ ID NO: 436; VH4-34+CDR3-IL8_CDR1 Cow-_CDR2 E50S, SEQ ID NO: 437; VH4-34+CDR3-IL8_CDR1 G31D,Y32K CDR2 Cow, SEQ ID NO: 438; VH4-34+CDR3-IL8_CDR1 G31D,Y32K_CDR2 E50S, SEQ ID NO: 439). These IgGs were expressed, yield was determined by ELISA, and CXCR1 binding specificity was measured by flow cytometry as described above (Table 14).

TABLE 14

Expression yield and CXCR1 specificity for VH4-34 CDR3-IL8 IgGs having CDR1 and CDR2 modifications and paired with Lc V1-47 orV1-51

| HC VH4-34 CDR3-IL8+ | | nM IgG | | CXCR1/Parental Ratio | |
|---|---|---|---|---|---|
| Hc-CDR1 | Hc-CDR2 | V1-47 | V1-51 | V1-47 | V1-51 |
| G31D Y32K | VH4-34 | 1 | 2.5 | 3.6 | 3 |
| Cow | VH4-34 | 3 | 8.5 | 5.1 | 2.4 |
| VH4-34 | VH4-34 | 1.5 | −0.4 | 2.6 | 2.9 |
| G31D Y32K | E50S | 2 | 4.6 | 1.4 | 3 |
| Cow | E50S | — | 22.8 | 2.6 | 3.1 |
| VH4-34 | E50S | 3.3 | 3.3 | 3.3 | 1.8 |
| G31D Y32K | Cow | −0.1 | 2.3 | 2 | 2.6 |
| Cow | Cow | 0.7 | 4.9 | 4.6 | 3.1 |
| VH4-34 | Cow | 0.6 | 0.6 | 2.5 | 3.9 |

Example 9

Human germline light chains including, light chains that may be paired with a heavy chain comprising an ultralong CDR3, may be modified by any method known in the art. Such modifications may include the substitution of certain amino acid residues in the human light chain to those residues at corresponding positions in a bovine light chain sequence. The modified light chains may improve the yield of the antibody comprising the ultralong CDR3 and/or increase its binding specificity.

In an exemplary method, variants of V 1-51 were made by overlap PCR and subcloned into pFuse vector for expression as described in Example 4. The engineered variants of V1-51 had: i) substitutions 129V and N32G introduced in CDR1 (SEQ ID NO: 440), ii) residues DNN (amino acids 51-53) in CDR2 changed to GDT (SEQ ID NO: 441), iii) residues DNNKRP (SEQ ID NO: 471) in and near CDR2 changed to GDTSRA (SEQ ID NO: 472), or iv) the 14 residues at the N-terminus were made identical to the first 14 resides of BLV1H12 light chain with point mutations S2A, T5N, P8S, A12G, A13S, and P14L (SEQ ID NO: 443) or v) combining the changes set forth in ii) and iv) (SEQ ID NO: 444). These V1-51 variants were paired with heavy chains encoding VH4-34+CDR3-IL8 (SEQ ID NO: 430), VH4-34+CDR3-IL8 CDR1 Cow (SEQ ID NO: 432), VH4-34+CDR3-IL8_CDR2 Cow (SEQ ID NO: 433), or VH4-34+CDR3-IL8 CDR1 Cow CDR2 Cow, (SEQ ID NO: 436). Transfections and ELISA were carried out as described above, and flow cytometry was used to evaluate CXCR1 binding specificity as previously described, with the modification that cells were resuspended in 2% BSA in PBS plus 2 ug/ml Heparin sulfate, and IgGs were normalized to 10 nM during incubation on cells. Only certain combinations of heavy and light chains supported detectable expression (Table 15). Those combinations that expressed heavy and light chains were tested for CXCR1 binding specificity (Table 16).

TABLE 15

Expression yield (nM IgG) for VH4-34 + CDR3-IL8 variants and V1-51 variants

|  |  | VH4-34 CDR3-IL8 | VH4-34 CDR3-IL8 CDR1-Cow | VH4-34 CDR3-IL8 CDR2-Cow | VH4-34 CDR3-IL8 CDR1-Cow &CDR2-Cow |
|---|---|---|---|---|---|
|  | Hc CDR1: | Human | Cow | Human | Cow |
|  | CDR2: | Human | Human | Cow | Cow |
| V1-51 |  | 1 | 5 | 0 | 13 |
| V1-51 CDR1 I29V, N32G |  | −1 | 5 | 0 | 3 |
| V1-51 CDR2 DNN to GDT |  | −1 | 23 | −1 | 5 |
| V1-51 CDR2 DNNKRP (SEQ ID NO: 471) to GDTSRA (SEQ ID NO: 472) |  | −1 | 4 | 1 | 23 |
| V1-51 S2A, T5N, P8S, A12G, A13S, P14L |  | 0 | 38 | −1 | 22 |
| V1-51 S2A, T5N, P8S, A12G, A13S, P14L & DNN to GDT |  | 0 | 37 | 0 | 1 |

TABLE 16

CXCR1 specificity for VH4-34 + CDR3-IL8 variants and V1-51 variants

|  |  | VH4-34 CDR3-IL8 | VH4-34 CDR3-IL8 CDR1-Cow | VH4-34 CDR3-IL8 CDR2-Cow | VH4-34 CDR3-IL8 CDR1-Cow &CDR2-Cow |
|---|---|---|---|---|---|
|  | Hc CDR1: | Human | Cow | Human | Cow |
|  | CDR2: | Human | Human | Cow | Cow |
| V1-51 |  | nt | 7.2 | nt | 11.1 |
| V1-51 CDR1 I29V, N32G |  | nt | 8.9 | nt | 11.8 |
| V1-51 CDR2 DNN to GDT |  | nt | 5.6 | nt | 16.7 |
| V1-51 CDR2 DNNKRP (SEQ ID NO: 471) to GDTSRA (SEQ ID NO: 472) |  | nt | 8.0 | nt | 6.9 |
| V1-51 S2A, T5N, P8S, A12G, A13S, P14L |  | nt | 4.7 | nt | 12.2 |
| V1-51 S2A, T5N, P8S, A12G, A13S, P14L & DNN to GDT |  | nt | 6.8 | nt |  |

Example 10

Libraries may be generated that comprise an ultralong CDR3 including, for example libraries that comprise at least a portion of an ultralong CDR3, within an antibody framework (e.g., a heavy chain framework). Such libraries may comprise a diversity of ultralong CDR3 sequences, a diversity of one or more residues that are positioned between one or more cysteine residues in the cysteine domain of the ultralong CDR3, or a diversity of non-bovine peptides that may be inserted (e.g., replace a portion of) in the ultralong CDR3. The antibody framework may be derived from a bovine sequence such as VH-UL, a human germline sequence, or a modified human germline sequence such as described in Example 7. Heavy chains with diverse ultralong CDR3 may be paired with light chains of bovine, human, or modified composition (see, e.g., Example 9) for expression of a library of antibody or antibody fragments comprising a diverse ultralong CDR3.

In an exemplary method, a library is generated in which the library comprises a diversity of ultralong CDR3 sequences (e.g., the diversity in the library resides in that the library contains a plurality of diverse ultralong CDR3 sequences). For example, a plurality of diverse ultralong CDR3 sequences is obtained from cDNA extracted from the spleen and/or lymph nodes from either immunized or non-immunized cows. Alternatively, a plurality of diverse ultralong CDR3 sequences is captured as information from cDNA by sequencing technology, such as described in Example 2. cDNA-derived cow sequences are then amplified from the isolated cDNA or synthesized from sequencing of cDNA, and diverse CDR3 sequences are inserted into an antibody framework for expression of IgGs with ultralong CDR3 sequences, producing a library of IgGs with CDR3s derived from cows. The IgG library can exist in any format, including as a spatially addressed array see, e.g., WO 11/056997; and Mao et al. (2010) Nat Biotech 28:1195-1202).

In another exemplary method, a library is generated in which members of the library comprise an ultralong CDR3 with a certain cysteine domain, or multiple cysteine domains, wherein the members are diverse in one or more residues that are positioned between one or more cysteine residues in the cysteine domain. For example, in the sequence $CX_{10}CX_5CX_5CXCX_7C$ (SEQ ID NO: 41), a library is generated whereby any X residue is changed, or combination of X residues are changed, to produce diversity within CDR3. Such diversity is introduced by degenerate nucleotide synthesis, error prone PCR, gene synthesis, or any other method known in the art to make changes in nucleotide sequences. These ultralong CDR3 loops are then integrated with sequence encoding the antibody framework. Heavy chain sequences are then paired with human or modified human light chain sequences for co-transfection and expression to comprise an antibody library engineered from bovine CDR3s.

In another exemplary method, a library is generated in which members of the library comprise an ultralong CDR3 with diversity in a non-bovine sequence inserted into (e.g., replace a portion of) the ultralong CDR3. Ultralong CDR3s tolerate large non-bovine sequence insertions (e.g., cytokines, peptide hormones, signaling domains, and constituent proteins of arthropod toxins or reptile venoms) including, for example, cysteine rich insertions, within an antibody framework, and support the independent function of the peptide encoded by the non-bovine sequence, as demonstrated in Example 4 and Example 6. Sequences encoding non-bovine sequences are amplified by PCR from cDNA or synthesized, and incorporated with or without linker sequences, into an antibody sequence such that they are expressed within, in place of, or replace at least a portion of, an ultralong CDR3. Exemplary methods to insert a non-bovine sequence into a vector for expression are set forth in Example 3 above. Heavy chain sequences are then paired with human or modified human light chain for co-transfection and expression. For example, a non-bovine sequence is inserted into HC pFUSE, encoding VH4-34*02 with CDR1 and CDR3 modifications from BLV1H12. Briefly, the portion of the HC pFuse vector comprising a BsaI cassette (see, Example 3; bolded in the sequence below) which is flanked on both sides by a portion of an ultralong CDR3 (underlined sequence below) is replaced by a non-bovine sequence.

(SEQ ID NO: 472)
caggtgcagctacagcagtggggcgcaggactgttgaagccttcggagac gctgtccctcacctgcacagcaagcgggttttcactgagcgacaaggcag tgggatggattcgccagccccaggggaaggggctggagtggattgggggaa atcaatcatagtggaagcaccaactacaacccgtccctcaagagtcgagt caccatatcagtagacacgtccaagaaccagttctccctgaagctgagct ctgtgaccgccgcggacacggctgtgtattactgt<u>acctctgtgcaccag</u>

<u>gaaactaagaaataccagagc</u>gagacctactatggttcgggtctc<u>tctta</u>

<u>tacctacaattatgaatgg</u>catgtggatgtctggggacagggcctgctgg tgacagtctctagtgctagc

After replacement of the BsaI cassette with the non-bovine sequence the non-bovine sequence (referred to as insert in bold text in the sequence below) is positioned such that it is flanked on both sides by a portion of the ultralong CDR3.

(SEQ ID NO: 473)
qvqlqqwgagllkpsetlsltctasgfslsdkavgwirq<u>ppgkglewige</u>

<u>inhsgstnynpslksrvtisvdtsknqfslklssvtaadtavyyctsvhq</u>

<u>etkkyqs</u>- insert -<u>sytynyew</u>hvdvwgqgllvtvssas

Heavy chain sequences are then paired with human or modified human light chain for co-transfection and expression.

Example 11

Human germline light chains, including light chains that may be paired with a heavy chain comprising an ultralong CDR3, may be modified by any method known in the art. Such modifications may include the substitution of certain amino acid residues in the human light chain.

Light Chain V1-51 variants as described in Example 9 were modified by overlap PCR and subcloned into pFuse vectors to introduce K46R and L47T mutations. As an example, V1-51 with the point mutations S2A, T5N, P8S, A12G, A13S, P14L, D51G, N52D, and N53T (SEQ ID NO: 444; SEQ ID NO:792) was modified to also include mutations K46R and L47T, encoding V1-51 with point mutations S2A, T5N, P8S, A12G, A13S, P14L, K46R, L47T, D51G, N52D, and N53T (SEQ ID NO: 486; SEQ ID NO: 780). In further examples, overlap PCR was used to combine previous V1-51 point mutation groupings with the K46R and L47T point mutations, to make i) VL1-51 S2A, T5N, P8S, A12G, A13S, P14L, K46R, L47T, D51G, N52D, N53T, K54S, P56A (SEQ ID NO: 487; SEQ ID NO: 781), ii) VL1-51 I29V, N32G, K47R, L47T, D51G, N52D, N53T (SEQ ID NO: 488; SEQ ID NO: 782), iii) VL1-51 I29V, N32G, K47R, L47T, D51G, N52D, N53T, K54S, P56A (SEQ ID NO: 489; SEQ ID NO: 783).

Humanized antibodies, including those generated as described in Example 5, may be modified, for example, to comprise one or more amino acid changes/substitutions in the heavy chain variable region (see, e.g., Example 7). In an exemplary method, certain residues of VH-34 were selected for substitution or modification.

Using overlap PCR, VH4-34+CDR3-IL8 constructs with various mutations at CDR1 and CDR2 were further modified to encode point mutations Q5R and Q6E. As an example, the construct in example 5 encoding VH4-34+CDR3-IL8 (SEQ ID NO: 430; SEQ ID NO: 793), was modified to encode point mutations Q5R and Q6E (SEQ ID NO: 490; SEQ ID NO: 784). Related constructs with the CDR1 or CDR2 modifications described in Example 7 (SEQ ID NOs: 432-435; SEQ ID NO: 794-797), were also mutated to encode Q5R and Q6E, resulting in i) VH4-34+CDR3-IL8_CDR1-G31DY32K_Q5RQ6E (SEQ ID NO: 491; SEQ ID NO: 785), ii) VH4-34+CDR3-IL8_CDR2-E50S_Q5RQ6E (SEQ ID NO: 492; SEQ ID NO: 786), iii) VH4-34+CDR3-IL8_CDR1-Cow_Q5RQ6E (SEQ ID NO: 494; SEQ ID NO: 788), and iv) VH4-34+CDR3-IL8_CDR2-Cow_Q5RQ6E (SEQ ID NO: 495; SEQ ID NO: 789). CDR1-Cow refers to the group of mutations A23T, V24A, Y25S, G27F, F29L, G31D, Y32K, Y33A, W34V, and S35G. CDR2-Cow refers to the group of point mutations I48L, E50S, N52D, H53T, S54G, S56N, and N58G.

Vectors, for example, as described in Example 8, encoding the combinations of both CDR1 and CDR2 modifications (SEQ ID NOs: 436, 437, and 439; SEQ ID NOs: 798, 799, 801) were also modified by PCR to add the additional point mutations Q5R and Q6E resulting in i) VH4-34+CDR3-IL8_CDR1-G31DY32K_CDR2-E50S_Q5RQ6E (SEQ ID NO: 493; SEQ ID NO: 787), ii) VH4-34+CDR3-IL8_CDR1-Cow_CDR2-E50S_Q5RQ6E (SEQ ID NO: 496; SEQ ID NO: 790), and iii) VH4-34+CDR3-IL8_CDR1-Cow_CDR2-Cow_Q5RQ6E (SEQ ID NO: 497; SEQ ID NO: 791).These new VH4-34 variants containing mutations Q5R and Q6E are summarized in Table 17.

TABLE 17

| Nucleotide SEQ ID NO: | VH4-34 + CDR3-IL8 with Q5R, Q6E and CDR1 and/or CDR2 mutation | | |
|---|---|---|---|
| | Construct Name: | CDR1 | CDR2 |
| 490 | VH4-34 + CDR3-IL8_Q5RQ6E | Human | Human |
| 491 | VH4-34 + CDR3-IL8_CDR1-G31DY32K_Q5RQ6E | G31D, Y32K | Human |
| 492 | VH4-34 + CDR3-IL8_CDR2-E50S_Q5RQ6E | Human | E50S |
| 493 | VH4-34 + CDR3-IL8_CDR1-G31DY32K_CDR2-E50S_Q5RQ6E | G31D, Y32K | E50S |
| 494 | VH4-34 + CDR3-IL8_CDR1-Cow_Q5RQ6E | Cow | Human |
| 495 | VH4-34 + CDR3-IL8_CDR2-Cow_Q5RQ6E | Human | Cow |
| 496 | VH4-34 + CDR3-IL8_CDR1-Cow_CDR2-E50S_Q5RQ6E | Cow | E50S |
| 497 | VH4-34 + CDR3-IL8_CDR1-Cow_CDR2-Cow_Q5RQ6E | Cow | Cow |

Example 12

Humanized germline sequences, including modified human germline sequences, that comprise an ultralong CDR3 may be evaluated by any method known in the art to identify and characterize sequences that permit expression of an ultralong CDR3, including an ultralong CDR that comprises a non-antibody sequence.

Heavy chain constructs encoding variants of VH4-34+CDR3-IL8 (SEQ ID NOs: 430, 432-437, 439; SEQ ID NOs: 793, 794-799, 800) were paired with light chain constructs encoding variants of V 1-51 (SEQ ID NOs: 440, 441, 442, 443, 444, 456, and 486; SEQ ID NOs: 801, 802, 803, 804, 792, and 780) and transfected in 293Freestyle cells as described in Example 4. Yield of the resultant IgGs in supernatant was determined as in Example 4, and presented in Table 18. Heavy chains without mutations at CDR1 or CDR2 designated "Human" indicate that the sequence was unchanged from the VH4-34 human germline. CDR1-Cow refers to the group of mutations A23T, V24A, Y25S, G27F, F29L, G31D, Y32K, Y33A, W34V, and S35G. CDR2-Cow refers to the group of point mutations I48L, E50S, N52D, H53T, S54G, S56N, and N58G. Point mutations in CDR1 or CDR2 are indicated as well (e.g. G31D, Y32K; or E50S). The antibody expression yield in each square was determined by the level of IgG expression: higher numbers in squares exhibit better expression.

Cell culture supernatants from selected IgGs showing unexpectedly improved IgG expression were then normalized to 5 nM IgG and flow cytometry was used to evaluate CXCR1 binding specificity as previously described in Example 5. The ability of IL-8 within CDR3 in these antibodies to specifically bind CXCR1 receptor was evaluated by comparing the median fluorescence of cells expressing CXCR1 as compared to the median fluorescence of parental cells. The ratio of these median AFU was calculated and shown in Table 19. Heavy chains without mutations at CDR1 or CDR2 designated "Human" indicate that the sequence was unchanged from the VH4-34 human germline. CDR1-Cow refers to the group of mutations A23T, V24A, Y25S, G27F, F29L, G31D, Y32K, Y33A, W34V, and S35G. CDR2-Cow refers to the group of point mutations I48L, E50S, N52D, H53T, S54G, S56N, and N58G. Point mutations in CDR1 or CDR2 are indicated as well (e.g. G31D, Y32K; or E50S). Specific binding was determined by the ratio of median AFU of CXCR1 cells to that of parental cells: higher numbers show a higher ratio and thus more specific binding.

TABLE 18

| | | VH4-34 + CDR3-IL8 and Mutations at CDR1 and/or CDR2 | | | | | | | |
|---|---|---|---|---|---|---|---|---|---|
| | | Heavy Chain SEQ ID NO: | | | | | | | |
| Light Chain SEQ ID NO: | | 430 | 434 | 435 | 439 | 432 | 433 | 437 | 436 |
| | | CDR1: | | | | | | | |
| | | Human | G31D, Y32K | Human | G31D, Y32K | Cow | Human | Cow | Cow |
| | | CDR2: | | | | | | | |
| | | Human | Human | E50S | E50S | Human | Cow | E50S | Cow |
| 456 | VL1-51 | 0 | 0 | 0 | 0 | 0 | 1 | 0 | 0 |
| 440 | VL1-51 I29V, N32G | 1 | 1 | 1 | 1 | 1 | 1 | 1 | 0 |
| 441 | VL1-51 D51G, N52D, N53T | 1 | 1 | 1 | 19 | 0 | 1 | 3 | 4 |
| 442 | VL1-51 D51G, N52D, N53T, K54S, P56A | 2 | 2 | 3 | 3 | 5 | 2 | 2 | 19 |
| 443 | VL1-51 S2A, T5N, P8S, A12G, A13S, P14L | 4 | 7 | 7 | 22 | 20 | 3 | 47 | 25 |
| 444 | VL1-51 S2A, T5N, P8S, A12G, A13S, P14L, D51G, N52D, N53T | 13 | 29 | 22 | 54 | 56 | 3 | 47 | 90 |
| 486 | VL1-51 S2A, T5N, P8S, A12G, A13S, P14L, K46R, L47T, D51G, N52D, N53T | 37 | 34 | 25 | 88 | 68 | 8 | 81 | 98 |

Antibody Expression Yield (nM IgG)

TABLE 19

VH4-34 + CDR3-IL8 and Mutations at CDR1 and/or CDR2

| Light Chain SEQ ID NO: | | Heavy Chain SEQ ID NO: | | | | | | | |
|---|---|---|---|---|---|---|---|---|---|
| | | 430 | 434 | 435 | 439 | 432 | 433 | 437 | 436 |
| | | | | | CDR1: | | | | |
| | | Human | G31D, Y32K | Human | G31D, Y32K | Cow | Human | Cow | Cow |
| | | | | | CDR2: | | | | |
| | | Human | Human | E50S | E50S | Human | Cow | E50S | Cow |
| 443 | VL1-51 S2A, T5N, P8S, A12G, A13S, P14L | | 4 | 4 | 5 | 4 | | 5 | 11 |
| 444 | VL1-51 S2A, T5N, P8S, A12G, A13S, P14L, D51G, N52D, N53T | 3 | | 2 | 17 | 4 | 4 | 6 | 10 |
| 486 | VL1-51 S2A, T5N, P8S, A12G, A13S, P14L, K46R, L47T, D51G, N52D, N53T | 12 | 15 | 5 | 18 | 10 | 3 | 6 | 13 |

Specific Binding: (CXCR1-Cell median AFU/Parental Cell median AFU)

Example 13

Humanized germline sequences, including modified human germline sequences, that comprise an ultralong CDR3 may be evaluated by any method known in the art to identify and characterize sequences that permit expression of an ultralong CDR3, including an ultralong CDR that comprises a non-antibody sequence.

Light chain V1-51 S2A, T5N, P8S, A12G, A13S, P14L, D51G, N52D, N53T (SEQ ID NO:444), with the addition of mutations K46R, and L47T to produce VL1-51 S2A, T5N, P8S, A12G, A13S, P14L, K46R, L47T, D51G, N52D, N53T (SEQ ID NO: 486; SEQ ID NO: 780) unexpectedly showed improvement in both IgG expression and specific antibody binding when paired with several heavy chains tested in Example 12. We examined the K46R and L47T pair of mutations in other V 1-51 variant light chains described in Example 11 (SEQ ID NOs: 487-489; SEQ ID NO: 781-783). We also examined the addition of the Q5R, Q6E pair of mutations in VH4-34+CDR3-IL-8 variant heavy chains described in Example 11, Table 17 (SEQ ID NOs: 490-497; SEQ ID NO: 784-791). Heavy chain constructs encoding variants of VH4-34+CDR3-IL8 with mutations Q5R and Q6E (SEQ ID NOs: 490-497; SEQ ID NO: 784-791) were paired with light chain constructs encoding variants of V 1-51, some of which had mutations K46R and L47T (SEQ ID NOs: 444, 486-489; SEQ ID NOs: 792, 780-783). These heavy and light chain pairs were each transfected in 293Freestyle cells as described in Example 4. Yield of the resultant IgGs in supernatant was determined as in Example 4, and presented in Table 20. Heavy chains without mutations at CDR1 or CDR2 designated "Human" indicate that the sequence was unchanged from the VH4-34 human germline. CDR1-Cow refers to the group of mutations A23T, V24A, Y25S, G27F, F29L, G31D, Y32K, Y33A, W34V, and S35G. CDR2-Cow refers to the group of point mutations I48L, E50S, N52D, H53T, S54G, S56N, and N58G. Point mutations in CDR1 or CDR2 are indicated as well (e.g., Q5R, Q6E; G31D, Y32K; or E50S). Expression yield in each square was determined by the level of IgG expression: higher numbers in squares exhibit better expression.

TABLE 20

VH4-34 + CDR3-IL8, Q5R, Q6E, and Mutations at CDR1 and/or CDR2

| Light Chain SEQ ID NO: | | Heavy Chain SEQ ID NO: | | | | | | | |
|---|---|---|---|---|---|---|---|---|---|
| | | 490 | 491 | 492 | 493 | 494 | 495 | 496 | 497 |
| | | | | | CDR1: | | | | |
| | | Human | G31D, Y32K | Human | G31D, Y32K | Cow | Human | Cow | Cow |
| | | | | | CDR2: | | | | |
| | | Human | Human | E50S | E50S | Human | Cow | E50S | Cow |
| 444 | VL1-51 S2A, T5N, P8S, A12G, A13S, P14L, D51G, N52D, N53T | 7 | 19 | 8 | 25 | 4 | 2 | 32 | 18 |
| 486 | VL1-51 S2A, T5N, P8S, A12G, A13S, P14L, K46R, L47T, D51G, N52D, N53T | 18 | 5 | 6 | 28 | | 11 | 13 | 8 |
| 487 | VL1-51 S2A, T5N, P8S, A12G, A13S, P14L, K46R, L47T, D51G, N52D, N53T, K54S, P56A | 18 | 13 | 20 | 31 | 52 | 12 | 38 | 23 |
| 488 | VL1-51 I29V, N32G, K46R, L47T, D51G, N52D, N53T | 2 | 0 | 3 | 12 | 30 | 1 | 19 | 11 |
| 489 | VL1-51 I29V, N32G, K46R, L47T, D51G, N52D, N53T K54S, P56A | 2 | 1 | 5 | 7 | 31 | 1 | 29 | 2 |

Expression Yield, (nM IgG)

Cell culture supernatants from selected IgGs unexpectedly showing improved IgG expression were then normalized to 5 nM IgG and flow cytometry was used to evaluate CXCR1 binding specificity as previously described in Example 5. The ability of IL-8 within CDR3 in these antibodies to specifically bind CXCR1 receptor was evaluated by comparing the median fluorescence of cells expressing CXCR1 as compared to the median fluorescence of parental cells. The ratio of these median AFU was calculated as previously in Table 19. Heavy chains without mutations at CDR1 or CDR2 designated "Human" indicate that the sequence was unchanged from the VH4-34 human germline. CDR1-Cow refers to the group of mutations A23T, V24A, Y25S, G27F, F29L, G31D, Y32K, Y33A, W34V, and S35G. CDR2-Cow refers to the group of point mutations I48L, E50S, N52D, H53T, S54G, S56N, and N58G. Point mutations in CDR1 or CDR2 are indicated as well (e.g. G31D, Y32K; or E50S). Specific binding was determined by the ratio of median AFU of CXCR1 cells to that of parental cells: higher numbers show a higher ratio and thus more specific binding.

In an exemplary method, IL-8 activation of the CXCR1 receptor was tested using the CXCR1-U2OS DiscoveRx cells described above (Cat #93-0226C3, DiscoveRx).

The DiscoveRx cells are engineered such that upon activation by ligand, the resultant beta-arrestin recruitment to the GPCR also causes activation of a luminescent reporter enzyme present in the cell line. Lysis reagents and luminescence substrate are included in the PathHunter Detection Kit (Cat #93-001, DiscoveRx) which was used following manufacturer's instructions. U2OS-CXCR1 cells were plated at 15,000 cells per well and serum starved overnight in EMEM media without serum. Next, media was removed and cells were incubated 1 hour at 37° C. with 80 µl of 1:1 EMEM and PBS, containing dilutions of either IL-8 or IgG with IL-8 insertion in CDR3, or control antibody. After 1 hour, 40 µl of PathHunter Detection reagent mix was added. Subsequently, after an hour at room temperature the luminescence in each well was measured using a luminescence plate reader. Higher luminescence signal reveals more activation of the CXCR1 receptor at the tested concentrations of IL-8 or IgG. IgGs were purified by scaling up the transfection method of Example 4, and purification of the IgG from media using protein A sepharose following manufacturer's instructions (Cat #17-1279-03 GE Healthcare) and dialysis post-elution into PBS. Protein yield was determined by A280 and calculated molar extinction coefficient. The humanized antibodies in Table 22 were expressed and tested for activation of CXCR1.

TABLE 21

VH4-34 + CDR3-IL8, Q5R, Q6E, and Mutations at CDR1 and/or CDR2

| Light Chain SEQ ID NO: | | Heavy Chain SEQ ID NO: | | | | | | |
|---|---|---|---|---|---|---|---|---|
| | | 490 | 491 | 492 | 493 | 494 | 495 | 496 | 497 |
| | | | | | CDR1: | | | | |
| | | Human | G31D, Y32K | Human | G31D, Y32K | Cow | Human | Cow | Cow |
| | | | | | CDR2: | | | | |
| | | Human | Human | E50S | E50S | Human | Cow | E50S | Cow |
| 444 | VL1-51 S2A, T5N, P8S, A12G, A13S, P14L, D51G, N52D, N53T | | 2 | | 1 | | | 2 | 4 |
| 486 | VL1-51 S2A, T5N, P8S, A12G, A13S, P14L, K46R, L47T, D51G, N52D, N53T | 10 | | | 4 | 10 | 5 | 2 | |
| 487 | VL1-51 S2A, T5N, P8S, A12G, A13S, P14L, K46R, L47T, D51G, N52D, N53T, K54S, P56A | 3 | 2 | 1 | 3 | 3 | 1 | 2 | 2 |
| 488 | VL1-51 I29V, N32G, K46R, L47T, D51G, N52D, N53T | | | | 1 | 1 | | 1 | 1 |
| 489 | VL1-51 I29V, N32G, K46R, L47T, D51G, N52D, N53T K54S, P56A | | | | | 2 | | 2 | |

Specific Binding: (CXCR1-Cell median AFU/Parental Cell median AFU)

Example 14

Antibodies comprising an ultralong CDR3, including an ultralong CDR that comprises a non-antibody sequence, may be evaluated by any method known in the art for binding of the non-antibody sequence to its binding partner (e.g., via flow cytometry) and/or for activation (e.g., via cell-based luminescent assays).

TABLE 22

| BID# | HC SEQ ID NO: | Heavy Chain: | LC SEQ ID NO: | Light Chain |
|---|---|---|---|---|
| 34 | 432 | VH4-34 + CDR3-IL8_CDR1-Cow | 443 | VL1-51 S2A, T5N, P8S, A12G, A13S, P14L |
| 35 | 436 | VH4-34 + CDR3-IL8_CDR1-Cow_CDR2-Cow | 456 | VL1-51 |
| 36 | 436 | VH4-34 + CDR3-IL8_CDR1-Cow_CDR2-Cow | 443 | VL1-51 S2A, T5N, P8S, A12G, A13S, P14L |
| 37 | 439 | VH4-34 + CDR3-IL8_CDR1-G31DY32K_CDR2-E50S | 486 | VL1-51 S2A, T5N, P8S, A12G, A13S, P14L, K46R, L47T, D51G, N52D, N53T |

TABLE 22-continued

| BID# | HC SEQ ID NO: | Heavy Chain: | LC SEQ ID NO: | Light Chain |
|---|---|---|---|---|
| 38 | 493 | VH4-34 + CDR3-IL8_CDR1-G31DY32K_CDR2-E50S_Q5RQ6E | 486 | VL1-51 S2A, T5N, P8S, A12G, A13S, P14L, K46R, L47T, D51G, N52D, N53T |
| 39 | 436 | VH4-34 + CDR3-IL8_CDR1-Cow_CDR2-Cow | 486 | VL1-51 S2A, T5N, P8S, A12G, A13S, P14L, K46R, L47T, D51G, N52D, N53T |
| 43 | 494 | VH4-34 + CDR3-IL8_CDR1-Cow_Q5RQ6E | 486 | VL1-51 S2A, T5N, P8S, A12G, A13S, P14L, K46R, L47T, D51G, N52D, N53T |
| 42 | 393 | BLV1H12HC | 474 | CowULVL, Human Lambda C |

As shown in Tables 23 and 24, cells were treated with increasing concentrations of IL-8, either as free IL-8 control or as IL-8 in CDR3 of the above antibodies. IgGs comprised of CDR3-IL8 activated CXCR1 significantly more than IgG without CDR3-IL8. Concentration of IL-8 treatment is plotted, with the understanding that each IgG with CDR3-IL-8 contributes 2 IL-8 domains.

TABLE 23

CXCR1 Activation by Humanized IgGs with CDR3-IL-8

| | | BID # | | | | |
|---|---|---|---|---|---|---|
| | IgG nM | 37 VH4-34 MutC IL-8 31D32K50S | 38 VH4-34 MutE IL-8 5R6E31D32K50S | 39 VH4-34 MutD IL-8 CDR1cow CDR2cow | (IL-8) IL-8 | 42 BLV1H12 |
| nM IL-8 Domains | 100 | 15490 ± 7356 | 25920 ± 10105 | 21618 ± 5915 | 70182 ± 19176 | 5732 |
| | 25 | 11187 ± 2377 | 21049 ± 4878 | 15446 ± 2884 | 50500 ± 5922 | 5729 |
| | 6.25 | 7162 ± 1128 | 13509 ± 2708 | 10246 ± 252 | 28583 ± 3700 | 5776 |
| | 1.6 | 5712 ± 552 | 8161 ± 570 | 7398 ± 432 | 12230 ± 273 | 5820 |
| | 0.4 | 5419 ± 270 | 6188 ± 560 | 6307 ± 622 | 6527 ± 245 | 6485 |

TABLE 24

CXCR1 Activation by Humanized IgGs with CDR3-IL-8

| | | BID # | | | |
|---|---|---|---|---|---|
| | IgG nM | 36 VH4-34 MutB IL-8 CDR1cow CDR2cow | 43 VH4-34 MutF IL-8 5R6E CD1cow | 42 BLV1H12 | (IL-8) IL-8 |
| nM IL-8 Domains | 100 | 12253 ± 5812 | 18038 ± 9947 | 4347 ± 601 | 53969 ± 20263 |
| | 25 | 9552 ± 2569 | 14550 ± 4095 | 4747 ± 747 | 42188 ± 12385 |
| | 6.25 | 6166 ± 1377 | 10524 ± 1991 | 4546 ± 105 | 22259 ± 6430 |
| | 1.6 | 4991 ± 97 | 6407 ± 1086 | 4497 ± 437 | 8729 ± 1731 |
| | 0.4 | 4974 ± 398 | 5187 ± 468 | 4641 ± 698 | 4926 ± 760 |

Example 15

Humanized germline sequences, including modified human germline sequences, that comprise an ultralong CDR3, may be evaluated by any method known in the art to identify and characterize sequences that permit expression of an ultralong CDR3, including an ultralong CDR that comprises a non-antibody sequence.

As described in Example 3, a nucleotide sequence having a pair of BsaI sites (SEQ ID NO: 768) was introduced by PCR strand overlap extension into the nucleotide sequence encoding CDR3 of BLV1H12 (SEQ ID NO: 395). This sequence was then subcloned in-frame between the signal sequence and the nucleotide sequence encoding CH1-CH2-CH3 of human IgG1 in the HC pFuse vector (SEQ ID NO: 458) using EcoRI and NheI restriction enzymes. The nucleotide sequence containing BsaI sites was positioned between the codons expressing the ascending stalk portion of CDR3 (SEQ ID NO: 498), and the descending stalk portion of CDR3 (SEQ ID NO: 499), allowing the further insertion of nucleotide sequence in-frame with the ascending and descending stalk within CDR3.

For example, various linkers may be subcloned in frame with the ascending and descending stalk portions of CDR3, and such linker sequences may themselves have BsaI sites which can be used again for further insertion of, for example, more elaborate linkers, antibody knob libraries (e.g., cow knob libraries), or non-antibody sequences.

In an exemplary embodiment, sequences were designed for insertion between the BsaI sites in the heavy chain vector encoding BLV1H12 with BsaI sites at CDR3 (SEQ ID NO: 395) by directional cloning into the BsaI sites in frame with the ascending and descending stalk portions of CDR3.

Nucleotides were synthesized (IDTDNA, Inc.) to encode linker sequences flanking a new internal pair of BsaI sites useful for subsequent insertions between the new linkers. These Linker-BsaI-Linker sequences were introduced into BLV1H12 having BsaI sites at CDR3 (SEQ ID NO: 395) to produce BLV1H12-CDR3-Linker-BsaI vectors (SEQ ID NOs: 757-767) for further insertions within CDR3. In one example, the BsaI containing Nucleotide sequence was GAGACCTACTATGGTTCGGGTCTC (SEQ ID NO: 768). In another example, the BsaI containing nucleotide sequence was GAGACCTACTATGGTTCAGGGTCTC (SEQ ID NO: 769). The linkers surrounding the BsaI sites were produced as listed in Table 25, between the ascending stalk portion of CDR3 (SEQ ID NO: 498), and the descending stalk portion of CDR3 (SEQ ID NO: 499).

TABLE 25

Linkers in BLV1H12 CDR3 with BsaI sites for insertion of functional domains in CDR3 of an IgG.

| BLV1H12-CDR3-Linker-BsaI vectors | | Ascending Linker | | BsaI Pair | Descending Linker | |
|---|---|---|---|---|---|---|
| SEQ ID NO: | Linker Name | SEQ ID NO: | Amino Acid Sequence | SEQ ID NO: | SEQ ID NO: | Amino Acid Sequence |
| 757 | GGS1:1 | 579 | GGS | 768 | 579 | GGS |
| 758 | GGS1:2 | 579 | GGS | 768 | 580 | GGS GGS |
| 759 | GGS2:1 | 580 | GGS GGS | 768 | 579 | GGS |
| 760 | GGS2:2 | 580 | GGS GGS | 768 | 580 | GGS GGS |
| 761 | GGS2:3 | 580 | GGS GGS | 768 | 581 | GGS GGS GGS |
| 762 | GGS2:4 | 580 | GGS GGS | 768 | 582 | GGS GGS GGS GGS |
| 763 | GGS3:2 | 581 | GGS GGS GGS | 768 | 580 | GGS GGS |
| 764 | GGS3:3 | 581 | GGS GGS GGS | 768 | 581 | GGS GGS GGS |
| 765 | GGS4:2 | 582 | GGS GGS GGS GGS | 768 | 580 | GGS GGS |
| 766 | G4Sx1 | 723 | GGGGS GG | 769 | 575 | GGGGS |
| 767 | G4Sx3 | 724 | GGGGS GGGGS GGGGS GG | 769 | 577 | GGGGS GGGGS GGGGS |

Sequence encoding MOKA toxin (SEQ ID NO: 727; SEQ ID NO: 806) was inserted into the GGS1:1, GGS1:2, GGS2:1, GGS2:2, an GGS3:3 versions of BLV1H12-CDR3-Linker-BsaI vectors (SEQ ID NOs: 757-760, 764) to produce BLV1H12 heavy chain vectors that express MOKA toxin at CDR3 with a variety of linkers (SEQ ID NOs: 770-774). These MOKA and linker combinations in CDR3 of BLV1H12 were paired with CowULVL-Human LambdaC (SEQ ID NO: 474; SEQ ID NO: 807) for expression of IgGs as described in Example 4. All versions were found to express well (see, e.g., Moka constructs in Tables 26 and 27), and the GGS3:3 linker version (SEQ ID NO:774) was paired with CowULVL-Human LambdaC (SEQ ID NO: 474; SEQ ID NO: 807) for large scale transfection as described in Example 4, and purified as described in Examples 6 and 14 (see, e.g., FIG. 20, BID #33).

TABLE 26

Expression Yield of Antibodies with Toxin Domains in CDR3 of BLV1H12

| BID# | CDR3 Insert in BLV1H12: | nM |
|---|---|---|
| 201 | GGS1:1 ProTxII | 1.0 |
| 202 | GGS1:2 ProTxII | 0.7 |
| 203 | GGS2:1 ProTxII | −0.1 |
| 208 | GGS1:1 GG-ProTxII-GG | 1.0 |
| 209 | GGS1:2 GG-ProTxII-GG | 1.1 |
| 210 | GGS2:1 GG-ProTxII-GG | 3.4 |
| 204 | GGS1:1 Moka | 30.5 |
| 205 | GGS1:2 Moka | 47.9 |
| 206 | GGS2:1 Moka | 28.4 |

TABLE 27

Expression Yield of Antibodies with Toxin Domains and Linker Combinations in CDR3 fo BLV1H12

| BID # | CDR3 Insert in BLV1H12: | Ascending linker | Toxin | Desceding linker | nM |
|---|---|---|---|---|---|
| 201 | GGS 1:1 ProTxII | GGS | ProTxII | GGS | −2 |
| 202 | GGS 1:2 ProTxII | GGS | ProTxII | GGSGGS | −1 |
| 203 | GGS 2:1 ProTxII | GGSGGS | ProTxII | GGS | −2 |
| 204 | GGS 1:1 Moka | GGS | G-Moka | GGS | 106 |
| 205 | GGS 1:2 Moka | GGS | G-Moka | GGSGGS | 74 |
| 206 | GGS 2:1 Moka | GGSGGS | G-Moka | GGS | 99 |
| 207 | GGS 3:3 Moka | GGSGGSGGS | G-Moka | GGSGGSGGS | 81 |
| 208 | GGS 1:1 GG-ProTxII-GG | GGSGG | ProTxII | GGGGS | −1 |
| 209 | GGS 1:2 GG-ProTxII-GG | GGSGG | ProTxII | GGGGSGGS | −2 |
| 210 | GGS 2:1 GG-ProTxII-GG | GGSGGSGG | ProTxII | GGGGS | −1 |
| 211 | GGS 2:2 ProTxII | GGSGGS | ProTxII | GGSGGS | −1 |
| 212 | GGS 2:4 ProTxII | GGSGGS | ProTxII | GGSGGSGGSGGS | −1 |
| 213 | GGS 4:2 ProTxII | GGSGGSGGSGGS | ProTxII | GGSGGS | 3 |
| 214 | GGS 2:2 GG-ProTxII-GG | GGSGGSGG | ProTxII | GGGGSGGS | 0 |
| 215 | GGS 2:3 GG-ProTxII-GG | GGSGGSGG | ProTxII | GGGGSGGSGGS | −1 |

TABLE 27-continued Expression Yield of Antibodies with Toxin Domains and Linker Combinations in CDR3 fo BLV1H12

| BID # | CDR3 Insert in BLV1H12: | Ascending linker | Toxin | Desceding linker | nM |
|---|---|---|---|---|---|
| 216 | GGS 2:4 GG-ProTxII-GG | GGSGGSGG | ProTxII | GGGGSGGSGGSGGS | 0 |
| 217 | GGS 3:2 GG-ProTxII-GG | GGSGGSGGSGG | ProTxII | GGGGSGGS | −1 |
| 218 | GGS 3:3 GG-ProTxII-GG | GGSGGSGGSGG | ProTxII | GGGGSGGSGGS | 0 |
| 219 | GGS 4:2 GG-ProTxII-GG | GGSGGSGGSGGSGG | ProTxII | GGGGSGGS | 4 |
| 42 | BLV1H12 | n/a | n/a | n/a | 76 |

Sequences encoding ShK toxin (SEQ ID NO: 648; SEQ ID NO: 808), ProTxII (SEQ ID NO: 640; SEQ ID NO: 809), GPTX toxin (SEQ ID NO: 655; SEQ ID NO: 810), OSK1 toxin with mutations P12, K16, D20, (SEQ ID NO: 728; SEQ ID NO: 811) and OSK1 toxin with mutations K16 and D20 (SEQ ID NO: 729; SEQ ID NO: 812) were introduced into the BsaI sites of BLV1H12-CDR3-G4Sx3-BsaI (SEQ ID NO:767) to produce each of these toxins in the CDR3 of BLV1H12 flanked by $(G_4S)_3$ linkers (SEQ ID NOs: 775-779). These heavy chains were paired with Cow ULVL-Human LambdaC (SEQ ID NO: 474; SEQ ID NO: 807), and transfected as described in Example 4. Yield of the resultant IgGs in supernatant was determined as in Example 4, and presented in Table 27. Strand overlap elongation was used to modify the BLV1H12-CDR3-G4Sx3-BsaI (SEQ ID NO: 767), replacing the J region from Cow with the most similar Human J region (analogous to SEQ ID No. 14 and 15). Sequences encoding ShK toxin (SEQ ID NO: 648; SEQ ID NO: 808), ProTxII (SEQ ID NO: 640; SEQ ID NO: 809), GPTX toxin (SEQ ID NO: 655; SEQ ID NO: 810), OSK1 toxin with mutations P 12, K16, D20, (SEQ ID NO: 782; SEQ ID NO: 811), and OSK1 toxin with mutations K16 and D20 (SEQ ID NO: 729; SEQ ID NO: 812) were introduced into the BsaI sites of BLV1H12-HumanJ-CDR3-G4Sx3-BsaI (caggtccagctgagagagagcggccccttcactggtcaagccatcccagacactgagcctgacatgcacagcaagcgggttttcactga gcgacaaggcagtgggatgggtccgacaggcaccaggaaaagccctggaatggctgggcagcatcgataccggcgggaacacagg gtacaatcccggactgaagagcagactgtccattaccaaggacaactctaaaagtcaggtgtcactgagcgtgagctccgtcaccacaga ggatagtgcaacttactattgcacctctgtgcaccaggaaactaagaaataccagagcggtggaggaggttctggaggcggtggaagtg gtggcggaggtagcggaggatgagacctactatggttcagggtctctggaggtggtggatctggtggaggaggcagtggaggtggtgg cagctcttatacctacaattatgaatggcatgtggatgtctggggccaaggaaccctggtcaccgtctcctagctagc (SEQ ID NO: 957)) to produce each of these toxins in the CDR3 of BLV1H12 with Human J and flanked by (G4S)3 linkers (BID Nos 220-224 of FIGS. 21 and 22) These heavy chains were paired with Cow ULVL-Human LambdaC (SEQ ID NO: 474; SEQ ID NO: 807), and transfected as described in Example 4. Yield of the resultant IgGs in supernatant was determined as in Example 4, and presented in Table 28. The BLV1H12 CDR3 Toxin constructs without the Human J modification (SEQ ID NOs: 775-779) were paired with Cow ULVL-Human LambdaC (SEQ ID NO: 474; SEQ ID NO: 807) for large scale transfection as described in Example 4, and purified as described in Examples 6 and 14.

TABLE 28

Expression Yields of Antibodies with Toxins, Long Linkers and J region in CDR3 of BLV1H2

| BID# | CDR3 Insert in BLV1H12: | J region | nM IgG |
|---|---|---|---|
| 220 | 3xG4S ProTxII | Human | 10.7 |
| 221 | 3xG4S ShKtoxin | Human | 18.1 |
| 222 | 3xG4S OSK1 (K16, D20) | Human | 26.1 |
| 223 | 3xG4S OSK1 (P12, K16, D20) | Human | 33.4 |
| 224 | 3xG4S GPTX | Human | 34.2 |
| 227 | 1:2GGS G-Moka | Cow | 54.2 |
| 228 | 3xG4S ProTxII | Cow | 22.4 |
| 229 | 3xG4S ShKtoxin | Cow | 32.7 |
| 230 | 3xG4S OSK1 (K16, D20) | Cow | 19.5 |
| 231 | 3xG4S OSK1 (P12, K16, D20) | Cow | 27.9 |
| 232 | 3xG4S GPTX | Cow | 36.9 |
| 42 | BLV1H12 | Cow | 50.9 |

Using, for example, overlap PCR, the toxin inserts in BLV1H12 can be grafted to any of the described variants of VH4-34 heavy chains, or other desired Human VH or modified Human VH regions for expression and testing of these toxins in a humanized antibody.

Example 16

Antibodies comprising an ultralong CDR3, including an ultralong CDR that comprises a non-antibody sequence (e.g., a toxin), may be evaluated by any method known in the art (e.g., via cell-based inhibition assays).

Antibodies expressing ShK toxin (SEQ ID NO: 779) or MOKA toxin (SEQ ID NO: 774) were expressed in Example 15 using the method described in Example 4, and purified as described in Examples 6 and 14. These toxins are both reported to inhibit KV1.3, whose activity is required for T-cell stimulation. We sought to evaluate the ability of these toxins, when expressed in the CDR3 of an IgG, to inhibit the stimulation of T-cells in a manner similar to the free toxin.

To assay T-cell stimulation, T-cells were purified from peripheral blood mononucleocytes and cultured. Human Blood was collected from donors into sterile collection tubes pre-treated with EDTA to prevent coagulation. Each 15 ml of blood yielded approximately $10^7$ peripheral blood mononucleocytes (PBMCs) and $5\times10^6$ T-cells. Blood sample volumes of 15 mL were then transferred to 50 mL tubes containing 20 mL of 2 mM EDTA in PBS. 14 mL of Lymphocyte Separation Media (Corning, Catalog #: 25-072-CI) was slowly pipetted into the bottom of each tube to create a clean layer of Ficoll below the diluted blood sample. Next, samples were centrifuged at room temperature in a swinging bucket rotor at 400×g for 35 minutes. During the centrifuge decelleration, no brake was set to minimize disruption of the buffer-Ficoll interface, and the PBMCs enriched at this interface. The now separated PBMCs were carefully pipetted into a new 50 mL conical tube containing 30 mL of 2 mM EDTA in PBS. These tubes were centrifuged at room temperature at 300×g for 10 minutes to remove excess platelets. The brake was reapplied to this and subsequent centrifugations. Supernatant was aspirated and the pellet was resuspended in 30 mL of 2 mM EDTA in PBS. Samples were centrifuged at room temperature at 200×g for 10 minutes for additional platelet removal. Supernatant was aspirated and pellets were resuspended in 5 mL of T-Cell Media (RPMI Media with 1% 100× Pen/Strep/Glutamine, 10% Heat Inactivated FBS, 25 mM HEPES 10 uM 2-mercaptothanol) and cells were counted in the resultant fraction enriched for PBMCs To purify T-cells from PBMCs a magnetic bead based isolation kit was used (Dynabeads Untouched Human T-cells, cat #11344D, Invitrogen). 1×10$^7$ PBMCs were pelleted in a 15 mL conical tube by spinning for 5 minutes in a clinical centrifuge. Manufacturers instructions were followed, scaled to the cell count above, with the modification that cells were kept at 4 degrees Celsius or on ice. Isolated cells were resuspended in 2.5 mL of T-cell Media, and transferred into culture flasks.

To activate T-cells, 96 well plates were coated overnight at 4 degrees Celsius with anti-CD3 (Ebiosciences, cat #160037-81), 1 ug/ml in PBS, 100 ul per well. Plates were emptied and blocked with T-cell media containing 5% serum for 1 hour at 37 degrees Celsius. In another plate, T-cells were pre-treated with IgGs having either ShK toxin or MOKA toxin at CDR3 for 1.5 hours before activation. 8×10$^4$ cells per well in T-cell media with 10% serum were combined 1:1 with IgG in PBS in a final volume of 100 ul. Anti-CD28 antibody (clone CD28.6, cat #16-0288-81, Ebiosciences) was diluted in T-cell media (5% serum) to 10 ug/ml. 10 ul was transferred to each well of pre-incubated T-cells with IgG. Wells were mixed and 100 ul of T-cells, test IgG, Anti-CD28 mix was transferred to the Anti-CD3 coated plates and incubated 20 hrs 37 C. After incubation, supernatants were assayed for markers of T-cell activation: secreted TNFα and IL-2. To assay TNFα in the T cell supernatants, the Human TNFα ELISA Read-SET-Go! (Catalog #: 88-7346-22, eBioscience) kit was used following manufacturers instructions. IL-2 in T cell supernatants was assayed by sandwich ELISA using a mouse anti-hIL-2 (cat # MAB602, R&D Systems) capture antibody, rabbit anti-hIL-2, (Abcam, cat # ab9618) detection antibody, and goat anti-rabbit IgG-HRP (Jackson ImmunoResearch, cat #111-035-144) for signal detection using TMB Substrate (BioFX Laboratories, Catalog #: TMBS-1000-01). T-cell activation was measured by ELISA of TNFα or IL-2 secreted into cell culture media. Results of T-cell activation in the presence of varying concentrations of BLV1H12 IgGs having either ShK toxin (SEQ ID NO: 779) or MOKA toxin (SEQ ID NO: 774) at CDR3 were plotted and data was fit to a 4 parameter sigmoidal dose response curve using Kaleida-Graph (Synergy Software, Reading Pa.) to determine EC$_{50}$ concentrations (Table 29). Experiments were done in triplicate and repeated with multiple T-cell donors. Unstimulated T-cells were tested as a negative control and Stimulated T-cells with no antibody treatment were tested as positive controls. EC$_{50}$ concentrations were calculated separately for each donor, and for each of TNFα or IL-2 for each toxin.

TABLE 29

EC50 for Toxins in CDR3 of IgG.

|  |  |  | EC$_{50}$ (nM) |
|---|---|---|---|
| ShK Toxin IgG | TNFα | Donor 1 | 6.5 |
|  |  | Donor 2 | 0.2 |
|  | IL-2 | Donor 1 | 0.1 |
|  |  | Donor 2 | 0.03 |
| MOKA Toxin IgG | TNFα | Donor 1 | 19.3 |
|  |  | Donor 2 | 38.2 |
|  | IL-2 | Donor 1 | 14.4 |
|  |  | Donor 2 | 40.2 |

Example 17

Antibodies comprising an ultralong CDR3, including an ultralong CDR that comprises a non-antibody sequence, may be evaluated by any method known in the art. For example, polynucleotides coding for humanized antibodies comprising an ultralong CDR3 may be expressed, including transiently expressed, in a host cell by any method known in the art. Exemplary humanized antibody sequences that comprise an ultralong CDR3, including an ultralong CDR that comprises a non-antibody sequence, were expressed and characterized.

As described in Example 15 for MOKA toxin, sequences encoding ProTxII (SEQ ID NO: 640; SEQ ID NO: 809) were inserted into the versions of BLV1H12-CDR3-Linker-BsaI vectors (SEQ ID NOs: 757-760, 762, 765) to produce BLV1H12 heavy chain vectors that express ProTxII toxin at CDR3 with a variety of linkers (BIDs 201-203, 211-213 of FIG. 21). In addition, sequences encoding ProTxII with the addition of two glycine residue on the n-terminal and c-terminal sides of the toxin were similarly inserted into the versions of BLV1H12-CDR3-Linker-BsaI vectors (SEQ ID NOs: 757-765) to produce BLV1H12 heavy chain vectors that express ProTxII toxin at CDR3 with a variety of linkers (BIDs 208-210, 214-219 of FIG. 21). These ProTxII and linker combinations in CDR3 of BLV1H12 were paired with CowULVL-Human LambdaC (SEQ ID NO: 474; SEQ ID NO: 807, see FIG. 22), and transfected as described in Example 4. Yield of the resultant IgGs in supernatant was determined as in Example 4, and presented in Tables 26 and 27.

Example 18

Antibodies comprising an ultralong CDR3, including an ultralong CDR that comprises a non-antibody sequence, may be evaluated by any method known in the art. For example, polynucleotides coding for humanized antibodies comprising an ultralong CDR3 may be expressed, including transiently expressed, in a host cell by any method known in the art. Exemplary humanized antibody sequences that comprise an ultralong CDR3, including an ultralong CDR that comprises a non-antibody sequence, were expressed and characterized.

Sequence encoding IL-8 (SEQ ID NO: 475) was introduced into the BsaI sites of BLV1H12-CDR3-G4Sx3-BsaI (SEQ ID NO: 767) and BLV1H12-CDR3-G4Sx1-BsaI (SEQ ID NO: 766) to produce heavy chains that express BLV1H12 with IL8 flanked by either 3×G4S or 1×G4S linker in CDR3 (BID 45 and 46 of FIG. 21). These were compared to the original BLV1H12 IL-8 with shorter linker, made by insertion of IL-8 (SEQ ID NO: 475) into the BsaI sites in CDR3 of BLV1H12 Heavy chain (SEQ ID NO: 395). All 3 of these IL-8 Heavy chains were paired with CowULVL-Human LambdaC (SEQ ID NO: 474; SEQ ID NO: 807), for large scale transfection as described in Example 4, and purified as described in Sample 6 and 14. These proteins were loaded on SDS-PAGE gel and coomassie stained for comparison with all the humanized Antibodies expressed and purified in Example 14, and listed in Table 22 as BID # s 34-39, 42, and 43, as well as the MOKA antibody used in Example 16. Table 30 specifies the IgG expression yield upon purification. SDS-PAGE followed by coomassie staining with both reduced and unreduced samples of BLV1H12 antibody (BID 42 of FIGS. 21 and 22), BLV1H12-IL8 (BID 44 of FIGS. 21 and 22), and Humanized IgG (BID 38 listed in Table 22) confirmed expression.

the BLV1H12 scaffold, we performed Dynamic Light Scattering (DLS) on the purified IgG samples. DLS was run on a Wyatt Dyna Pro Titan using disposable Uvettes. Laser power was adjusted to give intensity between 100,000 to 1,000,000 counts per second. Each sample was measured ten times for each measurement and ten measurements were made. Table 32 summarizes the results of the DLS studies, listing the radius in nM of particles in the sample. Only BID 43 had 2 discrete particle sizes in the sample, both with a radius much larger than expected for an antibody.

TABLE 31

CDR3-IL-8 activation of CXCR1 with humanized IgGs

| | | | BID # | | | |
|---|---|---|---|---|---|---|
| | | Soluble IL-8 | 38 VH4-34 MutE IL-8 5R6E31D32K50S | 43 VH4-34 MutF IL-8 5R6E CD 1 cow | 44 BLV1H12-IL8 | 42 BLV1H12 |
| | IgG nM | | | | | |
| nM IL-8 Domains | 200 | 50410 ± 5819 | 22309 ± 4546 | 25033 ± 1218 | 32163 ± 331 | 3104 ± 110 |
| | 44 | 54082 ± 12683 | 23287 ± 5576 | 24050 ± 3024 | 32601 ± 7899 | 3291 ± 50 |
| | 9.9 | 50313 ± 16599 | 17087 ± 5177 | 21935 ± 4874 | 25342 ± 9111 | 3489 ± 199 |
| | 2.2 | 25708 ± 9802 | 10321 ± 3172 | 13518 ± 2311 | 17599 ± 5140 | 3711 ± 221 |
| | 0.5 | 9791 ± 3223 | 5296 ± 582 | 6615 ± 736 | 9942 ± 3804 | 3681 ± 15 |
| | 0.1 | 4201 ± 447 | 4063 ± 121 | 4181 ± 116 | 4520 ± 457 | 3744 ± 298 |

TABLE 30

Expression Yield of Antibodies with Toxins in CDR3

| BID | IgG with CDR3 insert | nM Yield |
|---|---|---|
| 46 | BLV1H12 HC CowV, CDR3 IL-8, 3xG4S | 235 |
| 45 | BLV1H12 HC CowV, CDR3 IL-8, 1xG4S | 313 |
| 42 | BLV1H12 | 1100 |
| 44 | BLV1H12 HC CowV, CDR3 IL-8, | 796 |
| 38 | VH4-34 MutE IL-8 5R6E31D32K50S | 436 |
| 43 | VH4-34 MutF IL-8 5R6E CD1cow | 476 |
| 39 | VH4-34 MutD IL-8 CDR1cow CDR2cow | 335 |
| 36 | VH4-34 IL-8 CDR1cow CDR2cow | 281 |
| 37 | VH4-34 MutE IL-8 31D32K50S | 259 |
| 34 | VH4-34 MutA IL-8 CD1Cow | 258 |
| 35 | VH4-34 IL-8 CDR1cow CDR2cow | 208 |
| 33 | Moka 3:3 | 483 |

TABLE 32

DLS data for IgG IL-8

| IgG | BID# | R(nm) | % Pd | % Mass |
|---|---|---|---|---|
| BLV1H12 | 42 | 8.3 | 9.6 | 84.9 |
| BLV1H12 CDR3 IL-8 | 44 | 5.7 | 10.9 | 99.8 |
| VH4-34 MutE IL-8 5R6E31D32K50S | 38 | 6.4 | 10.9 | 99.9 |
| VH4-34 MutF IL-8 5R6E CD1cow Peak1 | 43 | 36.3 | 6 | 36.8 |
| VH4-34 MutF IL-8 5R6E CD1cow Peak2 | 43 | 3260 | 2.9 | 63.2 |

Example 19

Antibodies comprising an ultralong CDR3, including an ultralong CDR that comprises a non-antibody sequence, may be evaluated by any method known in the art (e.g., via activation assays, cell-based luminescent assays, Dynamic Light Scattering (DLS)).

As was described in Example 14, CXCR1 activation by IgGs with CDR3-embedded IL-8 was performed using CXCR1-U2OS DiscoveRx cells, and the PathHunter Detection Kit. Here, Humanized VH4-34 IgGs with IL-8 embedded in CDR3 (BID 38 and 43 FIGS. 21 and 22) are compared to the original BLV1H12-IL8 (BID 44 of FIGS. 21 and 22), with soluble IL-8 as positive control and BLV1H12 IgG (BID 42 of FIGS. 21 and 22) as negative control. Luminescece at each concentration of IgG or IL-8 tested is presented in Table 31. To assess the solubility and monodispersity of the humanized VH4-34 antibodies versus Example 20

Antibodies comprising an ultralong CDR3, including an ultralong CDR that comprises a non-antibody sequence, may be evaluated by any method known in the art. For example, polynucleotides coding for humanized antibodies comprising an ultralong CDR3 may be expressed, including transiently expressed, in a host cell by any method known in the art. Exemplary humanized antibody sequences that comprise an ultralong CDR3, including an ultralong CDR that comprises a non-antibody sequence, were expressed and characterized.

Several CDR3 inserts previously expressed in BLV1H12-CDR3 were amplified by PCR and joined using an overlap PCR approach to insert them into CDR3 of VH4-34 Mut E, producing sequences that encode heavy chain VH4-34 MutE 3xG4S IL-8 (BID 47 of FIG. 21), VH4-34 MutE 3xG4S ShK (BID 48 of FIG. 21), VH4-34 MutE 3xGGS MOKA (BID 49 of FIG. 21), VH4-34 MutE 3xG4S ProTxII (BID 53 of FIG. 21), VH4-34 MutE 3xG4S GPTX (BID 54 of FIG. 21), VH4-34 MutE 3xGGS NoKnob (BID 55 of FIG. 21), VH4-34 MutE 1xG4S ShK (BID 56 of FIG. 21), VH4-34 MutE 1xG4S ShK 16K (BID 57 of FIG. 21), and VH4-34 MutE 3xG4S ShK 16K (BID 58 of FIG. 21). These vectors encoding heavy chains were paired with light chain VL1-51

S2A T5N P8S A12G A13S P14L K46R L47T D51G N52D N53LK (SEQ ID NO: 486, see FIG. 22) for large scale transfection as described in Example 4, and purified as described in Example 6 and 14. SDS-PAGE and coomassie stain was performed on samples from BID 53-58 confirming expression.

Example 21

Antibodies comprising an ultralong CDR3, including an ultralong CDR that comprises a non-antibody sequence, may be evaluated by any method known in the art. For example, polynucleotides coding for humanized antibodies comprising an ultralong CDR3 may be expressed, including transiently expressed, in a host cell by any method known in the art. Exemplary humanized antibody sequences that comprise an ultralong CDR3, including an ultralong CDR that comprises a non-antibody sequence, were expressed and characterized (e.g., via HPLC, DLS, and DSF).

Using an overlap PCR approach, the pair of BsaI sites in the nucleotide sequence encoding CDR3 of BLV1H12 (SEQ ID NO: 395) was incorporated into the nucleotide sequence encoding CDR3 of VH4-34 MutE (caggtgcagctaaga-gagtggggcgcaggactgttgaagccttcggagacgctgtccctcacctgcgct-gtctatggtgggtccttcagt gacaagtactggagctggattcgccagccccca-gggaaggggctggagtggattgggagcatcaatcatagtggaagcaccaactaca acccgtccctcaagagtcgagtcaccatatcagtagacacgtccaagaaccagt-tctccctgaagctgagctctgtgaccgccgcggaca cggctgtgtattactgtac-ctctgtgcaccaggaaactaagaaataccagagcgagacctactatggt-tcgggtctctcttatacctacaatta tgaatggcatgtggatgtctggggacagggcctgctggtgacagtctctagt-gctagc (SEQ ID NO: 957)). Then, oligonucleotides encoding various linker sequences were used to amplify the ShK toxin sequence (SEQ ID NO: 648), and the resulting sequences, encoding ShK toxin (SEQ ID NO: 648) and flanking linkers, were introduced into VH4-34MutE-CDR3-BsaI to produce a series of progressively shorter linkers flanking ShK toxin in VH4-34 MutE CDR3 (BIDs 48, 104, 56 66, 65, 67, 61, 60, and 59 of FIG. 21), as well as a VH4-34 MutE encoding only stalk, with 3×GGS in place of the knob (BID 55 of FIG. 21). These vectors encoding heavy chains were paired with light chain VL1-51 S2A T5N P8S A12G A13S P14L K46R L47T D51G N52D N53LK (SEQ ID NO: 486, see FIG. 22) for large scale transfection as described in Example 4, and purified as described in Example 6 and 14, with the following modifications. The cell culture supernatant was separated from cells by spinning 5000×g for 10 minutes. Protein A sepharose Fast Flow (GE Healthcare, #17-1279-03) was dispensed into a disposable column. The amount of resin was determined by the size of the growth. Resin was washed with 20 column volumes of 1×PBS (137 mM NaCl, 2.7 mM KCl, 10 mM Sodium phosphate dibasic, 2 mM Potassium phosphate dibasic. After washing, the supernatant containing IgG was loaded onto the resin with the flow rate monitored not to exceed resin manufacturer specifications. A subsequent wash with 20 columns volumes of 1×PBS was conducted and the protein was eluted from the column using a 0.7 M arginine buffer pH 4.3. Fractions containing protein were combined and dialyzed into 1×PBS. After dialysis the protein solution was filtered over a 0.2 μm PES membrane. Samples were stored at 4° C.

SDS-PAGE and coomassie stain was performed on these purified IgGs in non-reducing conditions and SDS-PAGE and silver staining was performed in reducing conditions. These IgGs were also subjected to HPLC analysis, Dynamic Light Scattering (DLS) analysis, and Differential Scanning Fluorimetry (DSF). HPLC was run on an Agilent 1100 with a Sepax Zenix-C SEC-300 7.8×300 mm with a 3 μM bead size column held at 25° C. The running buffer was 0.28 M KPi and 0.3 M KCl pH 6.9 at a flow rate of 1 mL/min. A 20 μL sample injection was performed for each sample. Samples were monitored at 280 nm. Integration was achieved using Agilent software. In Table 33, the elution time for each IgG and the % monomer is tabulated.

As was described in Example 19, DLS was run on a Wyatt Dyna Pro Titan using disposable Uvettes. Laser power was adjusted to give intensity between 100,000 to 1,000,000 counts per second. Each sample was measured ten times for each measurement and ten measurements were made. Radius in nanometers of the particle, % polydispersity, and an estimate of % mass for the particle of indicated radius is tabulated in Table 33.

Differential scanning fluorimetry (DSF) was done on a BioRad iQ5 with a FAM (485 nm) filter for excitation and a ROX (625 nm) filter for emission. Analysis program was run starting at 25° C. and stopping at 100° C. Steps were at 1° C. intervals with a wait time of 30 seconds between steps with reads being done after waiting at the step. Prior to sample preparation a stock solution was made of 300× Sypro Orange (Life Technologies, # S6650). 1 μL of this was added to 19 μL of sample. Each sample was run in duplicate. Control sample was 1×PBS. Once the melt curves were obtained the derivative of the curve was taken and the melting transitions were assigned. Melting transition temperatures are tabulated in Table 33. Some melting transitions could not be determined (--).

TABLE 33

Biophysical Data for VH4-34 IgGs with ShK toxin in CDR3

| | | HPLC Data | | | | | | | |
|---|---|---|---|---|---|---|---|---|---|
| | VH4-34 MutE | % | Elution | DLS Data | | | DSF Data | | |
| BID# | ShK | monomer | time | R (nm) | Pd % | % Mass | Tm1 | Tm2 | Tm3 |
| 48 | 3xG4S | 95 | 8.215 | 4.2 | 10 | 98.6 | 66.8 | 73.6 | 80.4 |
| 104 | 2xG4S | 93 | 8.229 | 5.2 | 6.5 | 99.4 | 67.1 | — | — |
| 56 | 1xG4S | 88 | 8.391 | 6.1 | 9.7 | 91.5 | 67.3 | — | — |
| 66 | GGGG-ShK-GGGG | 68 | 8.742 | 7.1 | 10 | 79.4 | 67.5 | 73.7 | 80.9 |
| 65 | GSGG-ShK-GGGG | 72 | 8.749 | 4.8 | 9.7 | 94.5 | 67.5 | 73.7 | 80.9 |
| 67 | GGG-ShK-GGG | 64 | 8.824 | 4 | 0 | 91.5 | 67.5 | 73.7 | 80.9 |
| 61 | GG-ShK-GG | 72 | 8.888 | 6.6 | 7 | 95.7 | 67.5 | 73.7 | — |
| 60 | G-ShK-G | 70 | 8.774 | 5.1 | 10.6 | 51.9 | 67.5 | 73.7 | — |

TABLE 33-continued Biophysical Data for VH4-34 IgGs with ShK toxin in CDR3

| VH4-34 MutE | HPLC Data | | DLS Data | | DSF Data | | |
|---|---|---|---|---|---|---|---|
| BID# ShK | % monomer | Elution time | R (nm) | Pd % | % Mass | Tm1 | Tm2 | Tm3 |
| 59 No linker | 75 | 9.106 | 5.2 | 8 | 96.5 | 67.5 | — | — |
| 55 No Knob | 99 | 8.116 | 5.2 | 7.4 | 99.8 | 67.7 | — | — |

Example 22

Antibodies comprising an ultralong CDR3, including an ultralong CDR that comprises a non-antibody sequence, may be evaluated by any method known in the art. For example, polynucleotides coding for humanized antibodies comprising an ultralong CDR3 may be expressed, including transiently expressed, in a host cell by any method known in the art. Exemplary humanized antibody sequences that comprise an ultralong CDR3, including an ultralong CDR that comprises a non-antibody sequence, were expressed and characterized (e.g., via SDS-PAGE).

VH4-34 MutE 1×G4S ShK (BID 56 of FIG. 21) and VH4-34 MutE NoLinker ShK (BID59 of FIG. 21) were expressed and purified with light chain (SEQ ID NO: 486, see FIG. 22) as described in Example 21 from Freestyle 293 Cells. Additionally, CHO-S cells and MAXfectin transfection reagent were used per manufacturer instructions (Invitrogen, Carlsbad Calif.) to produce VH4-34 MutE 1×G4S ShK (BID 56 of FIGS. 21 and 22) and VH4-34 MutE NoLinker ShK (BID59 of FIGS. 21 and 22) from CHO-S cells. Supernatants from CHO-S cells were purified as described in Example 21. Samples purified from CHO-S cells and from 293F cells were subjected to SDS-PAGE and silver staining (FIG. 20). Cell-type specific cleavage of the heavy chain is seen in the case of 1×G4S linker, but not in the NoLinker ShK.

Example 23

Antibodies comprising an ultralong CDR3, including an ultralong CDR that comprises a non-antibody sequence (e.g., a toxin), may be evaluated by any method known in the art (e.g., via cell-based inhibition and ELISA assays).

Kv1.3 Toxins OSK1, ShK, and MOKA in CDR3 of BLV1H12 were assayed for T-cell inhibition. BLV1H12 GLLV 3×G4S OSK1 (K16,D20) (BID 26/230 of FIG. 21) BLV1H12 GLLV 3×G4S OSK1 (P12,K16,D20) (BID 27/231 of FIG. 21), BLV1H12 GLLV 3×G4S ShK (BID 29/229 of FIG. 21), BLV1H12 GGS1:2 Moka (BID 30/205 of FIG. 21), BLV1H12 GGS2:1 Moka (BID 31/206 of FIG. 21), BLV1H12 GGS1:1 Moka (BID 32/204 of FIG. 21), and BLV1H12 GGS3:3 Moka (BID 33/207 of FIG. 21) heavy chains were each paired with CowULVL-Human LambdaC (SEQ ID NO: 474; SEQ ID NO: 807, see FIG. 22), for large scale transfection as described in Example 4, and purified as described in Sample 6 and 14. T-cell inhibition assays were performed as described in Example 16, with 3 blood donors, and ELISA measurement of TNF-α secretion. Though responses vary in magnitude among donors, and for different toxins, the trend in Table 34 indicates that increasing concentrations of IgG-CDR3 toxin treatment results in less TNF-α secretion.

TABLE 34

| T-Cell inhibition by BLV1H12 IgGs with Kv1.3 inhibitory toxins in CDR3. ELISA for TNF-α secretion | | | | | | | | | |
|---|---|---|---|---|---|---|---|---|---|
| | | | BID # | | | | | | |
| | | [IgG] | 26 BLV1H12 GLLV 3xG4S OSK1 (K16, D20) | 27 BLV1H12 GLLV 3xG4S OSK1 (P12, K16, D20) | 29 BLV1H12 GLLV 3xG4S ShK | 30 BLV1H12 GGS1:2 Moka | 31 BLV1H12 GGS2:1 Moka | 32 BLV1H12 GGS1:1 Moka | 33 BLV1H12 GGS3:3 Moka |
| TNF-α ELISA (A450) | Donor 1 | 150 nM | 0.253 ± 0.071 | 0.171 ± 0.079 | 0.057 ± 0.008 | 0.209 ± 0.067 | 0.174 ± 0.006 | 0.114 ± 0.004 | 0.164 ± 0.005 |
| | | 50 nM | 0.556 ± 0.011 | 0.58 ± 0.146 | 0.056 ± 0.016 | 0.488 ± 0.075 | 0.329 ± 0.004 | 0.324 ± 0.029 | 0.295 ± 0.046 |
| | | 17 nM | 0.698 ± 0.049 | 0.651 ± 0.038 | 0.106 ± 0.002 | 0.609 ± 0.056 | 0.447 ± 0.048 | 0.383 ± 0.018 | 0.398 ± 0.02 |
| | | 6 nM | 0.641 ± 0.031 | 0.666 ± 0.019 | 0.133 ± 0.002 | 0.667 ± 0.031 | 0.51 ± 0.008 | 0.493 ± 0.005 | 0.487 ± 0.017 |
| | Donor 2 | 150 nM | 0.027 ± 0.008 | 0.037 ± 0 | 0.034 ± 0 | 0.018 ± 0.004 | 0.027 ± 0.009 | 0.028 ± 0.005 | 0.024 ± 0.005 |
| | | 50 nM | 0.075 ± 0.005 | 0.097 ± 0.005 | 0.053 ± 0.018 | 0.028 ± 0.006 | 0.031 ± 0.002 | 0.073 ± 0.001 | 0.024 ± 0.006 |
| | | 17 nM | 0.094 ± 0.002 | 0.108 ± 0.012 | 0.042 ± 0.01 | 0.032 ± 0.002 | 0.031 ± 0.004 | 0.094 ± 0.007 | 0.032 ± 0.01 |
| | | 6 nM | 0.096 ± 0.009 | 0.121 ± 0.012 | 0.06 ± 0.01 | 0.053 ± 0.006 | 0.035 ± 0.007 | 0.115 ± 0.003 | 0.032 ± 0 |
| | Donor 3 | 150 nM | 0.029 ± 0.003 | 0.037 ± 0 | 0.029 ± 0.005 | 0.034 ± 0.004 | 0.014 ± 0.004 | 0.03 ± 0 | 0.018 ± 0.002 |
| | | 50 nM | 0.102 ± 0.002 | 0.122 ± 0.012 | 0.057 ± 0.014 | 0.056 ± 0 | 0.023 ± 0.01 | 0.093 ± 0.011 | 0.028 ± 0.006 |
| | | 17 nM | 0.144 ± 0.039 | 0.168 ± 0.01 | 0.066 ± 0.028 | 0.063 ± 0.004 | 0.028 ± 0.003 | 0.129 ± 0.016 | 0.044 ± 0.001 |
| | | 6 nM | 0.159 ± 0.003 | 0.191 ± 0.02 | 0.07 ± 0.012 | 0.075 ± 0.007 | 0.043 ± 0.008 | 0.175 ± 0.002 | 0.053 ± 0.006 |

Example 24

Antibodies comprising an ultralong CDR3, including an ultralong CDR that comprises a non-antibody sequence, may be evaluated by any method known in the art (e.g., via T-cell activation or inhibition assays).

Kv1.3 Toxins ShK and MOKA were tested for T-cell inhibition activity, and comparing the effects of expression in BLV1H12, VH4-34 MutE (mutations in IgG 38,) or VH4-34 MutF (Mutations in IgG 43).

Using an overlap PCR approach, sequence encoding 3×G4S ShK or 3×GGS MOKA was inserted into VH4-34+CDR3-IL8_CDR1-Cow_Q5RQ6E (SEQ ID NO:494), replacing the IL-8 and producing VH4-34 MutF 3×G4S ShK (BID50 of FIG. 21) and VH4-34 MutF 3×GGS MOKA (BID52 of FIG. 21), respectively. These heavy chain encoding sequences were paired with light chain VL1-51 S2A T5N P8S A12G A13S P14L K46R L47T D51G N52D N53LK (SEQ ID NO: 486, see FIG. 22) for large scale transfection as described in Example 4, and purified as described in Example 6 and 14. Using the same light chain, VH4-34 MutE 3×G4S ShK (BID48 of FIGS. 21 and 22) IgG was produced and purified as described in Example 21, and VH4-34 MutE 3×GGS MOKA (BID49 of FIGS. 21 and 22) IgG was produced and purified as described in Example 20. BLV1H12 3×G4S ShK IgG and BLV1H12 GGS3:3 Moka IgG were produced as described in Example 23. BLV1H12 IgG was produced as described in Example 14. These IgGs were tested for T-cell inhibition as described in Example 16, using ELISA of secreted IL-2 and TNF-alpha as a measure of T-cell activation or inhibition as indicated in Table 35. Another iteration of this experiment is shown in Table 36.

TABLE 35

T-Cell inhibition by VH4-34 IgGs with Kv1.3 inhibiting toxins in CDR3. ELISA for IL-2 and TNF-α secretion.

| | | | BID # | | | | | | |
|---|---|---|---|---|---|---|---|---|---|
| | | [IgG] | 40 BLV1H12 GLLV 3xG4S ShK | 48 VH4-34 MutE 3xG4S ShK | 41 BLV1H12 GGS3:3 Moka | 49 VH4-34 MutE 3xGGS MOKA | 50 VH4-34 MutF 3xG4S ShK | 52 VH4-34 MutF 3xGGS MOKA |

TABLE 36-continued

T-Cell inhibition by IgG-CDR3-Toxins. ShK vs. MOKA, Cow vs. Humanized.

| | BID # | | | | |
|---|---|---|---|---|---|
| [IgG] nM | 40<br>BLV1H12 GLLV<br>3xG4S ShK | 48<br>VH4-34 MutE<br>3xG4S ShK | 33<br>BLV1H12<br>GGS3:3 Moka | 49<br>VH4-34 MutE<br>3xGGS MOKA | 55<br>VH4-34 MutE<br>No Knob |
| 9.4 | 0.1 ± 0.021 | 0.104 ± 0.007 | 0.721 ± 0.111 | 0.564 ± 0.039 | 0.622 ± 0.102 |
| 2.3 | 0.161 ± 0.02 | 0.14 ± 0.01 | 0.618 ± 0.09 | 0.575 ± 0.047 | — |
| 0.6 | 0.314 ± 0.047 | 0.281 ± 0.019 | 0.742 ± 0.121 | 0.57 ± 0.039 | 0.631 ± 0.053 |
| 0.15 | 0.385 ± 0.016 | 0.316 ± 0.014 | 0.717 ± 0.076 | 0.614 ± 0.072 | — |
| 0.04 | 0.554 ± 0.051 | 0.403 ± 0.041 | 0.745 ± 0.067 | 0.573 ± 0.026 | 0.736 ± 0.122 |
| 0.01 | 0.663 ± 0.058 | 0.487 ± 0.059 | 0.76 ± 0.058 | 0.627 ± 0.048 | — |

Example 25

Antibodies comprising an ultralong CDR3, including an ultralong CDR that comprises a non-antibody sequence, may be evaluated by any method known in the art (e.g., via T-cell inhibition assays).

We examined the effects of linker length on T-cell inhibition by ShK toxin in CDR3 of VH4-34 MutE IgGs. VH4-34 MutE 3xG4S ShK (BID 48 of FIGS. 21 and 22), VH4-34 MutE NoLinker ShK (BID59 of FIGS. 21 and 22), and the single and di-glycine linker versions VH4-34 MutE G-ShK-G (BID 60 of FIGS. 21 and 22), and VH4-34 MutE GG-ShK-GG (BID 61 of FIGS. 21 and 22). In addition the VH4-34 MutE 3×GGS NoKnob IgG (BID55 of FIGS. 21 and 22) and an irrelevant human IgG were used as negative controls. T-cell assays and ELISAs for IL-2 and TNF-alpha were performed as explained below in this Example, and the data is in Table 37. Seeing minor differences in linker Length on T-cell inhibition, we examined the intermediate linker length VH4-34 MutE ShK IgGs that we had previously purified. Samples of Purified IgGs VH4-34 MutE 1×G4S ShK (BID56 of FIGS. 21 and 22), VH4-34 MutE GSGG-Shk-GGGG (BID65 of FIGS. 21 and 22), VH4-34 MutE GGGG-Shk-GGGG (BID66 of FIGS. 21 and 22), VH4-34 MutE GGG-Shk-GGG (BID67 of FIGS. 21 and 22), and VH4-34 MutE GG-ShK-GG (BID61 of FIGS. 21 and 22) were tested for T-cell inhibition as described in Example 16. TNF alpha secretion was examined as described above. IL-2 secretion on the T cell supernatants was examined by ELISA using mouse anti-hIL2 (R&D Systems, cat # MAB602) coated on a maxisorp plate to capture IL-2 from the T-cell supernatants. Rabbit anti-hIL2, (Abcam, cat # ab9618) was used to detect bound IL-2, and goat anti-rabbit IgG-HRP (Sigma, cat # A 6154) was used with TMB Substrate (BioFX Laboratories, Catalog #: TMBS-1000-01) to develop the ELISA. A450 absorbance was measured with a TECAN Genios Plate reader, and tabulated in Table 38.

TABLE 37

T-Cell inhibition by IgG-CDR3-Toxins. Comparing Long and Short Linkers.

| | | | BID # | | | | |
|---|---|---|---|---|---|---|---|
| | | BID: [IgG] nM | 48 VH4-34 MutE 3xG4S ShK | 59 VH4-34 MutE Shk-No Linker | 60 VH4-34 MutE G-ShK-G | 55 VH4-34 MutE No Knob | Negative Control IgG |
| IL-2 ELISA (A450) | Donor 1 | 68 | 0.424 ± 0.026 | 0.472 ± 0.031 | 0.494 ± 0.105 | 1.418 ± 0.151 | 1.475 ± 0.043 |
| | | 15 | 0.6 ± 0.02 | 0.759 ± 0.069 | 0.709 ± 0.048 | — | — |
| | | 3.4 | 0.858 ± 0.046 | 1.078 ± 0.101 | 1.015 ± 0.016 | — | — |
| | | 0.75 | 0.944 ± 0.104 | 1.389 ± 0.024 | 1.407 ± 0.124 | 2.185 ± 0.239 | 2.112 ± 0.073 |
| | | 0.17 | 1.46 ± 0.092 | 1.874 ± 0.03 | 1.793 ± 0.004 | — | — |
| | | 0.04 | 1.751 ± 0.001 | 2.049 ± 0.101 | 1.953 ± 0.087 | — | — |
| | | 0.01 | 2.163 ± 0.057 | 2.251 ± 0.07 | 2.185 ± 0.089 | 2.182 ± 0.026 | 1.997 ± 0.105 |
| | | 0.00 | 2.001 ± 0.031 | 1.988 ± 0.034 | 1.937 ± 0.091 | — | — |
| | Donor 2 | 68 | 0.343 ± 0.017 | 0.369 ± 0.027 | 0.373 ± 0.038 | 1.317 ± 0.277 | 1.501 ± 0.159 |
| | | 15 | 0.407 ± 0.029 | 0.436 ± 0.022 | 0.402 ± 0.031 | — | — |
| | | 3.4 | 0.484 ± 0.047 | 0.506 ± 0.016 | 0.496 ± 0.02 | — | — |
| | | 0.75 | 0.479 ± 0.037 | 0.682 ± 0.045 | 0.674 ± 0.029 | 1.613 ± 0.063 | 1.563 ± 0.068 |
| | | 0.17 | 0.695 ± 0.087 | 0.936 ± 0.063 | 1.06 ± 0.072 | — | — |
| | | 0.04 | 1.039 ± 0.119 | 1.389 ± 0.042 | 1.484 ± 0.068 | — | — |
| | | 0.01 | 1.549 ± 0.019 | 1.643 ± 0.071 | 1.638 ± 0.087 | 1.75 ± 0.072 | 1.608 ± 0.077 |
| | | 0.00 | 1.616 ± 0.021 | 1.64 ± 0.063 | 1.62 ± 0.061 | — | — |
| TNF-α ELISA (A450) | Donor 1 | 68 | 0.151 ± 0.003 | 0.211 ± 0.027 | 0.186 ± 0.006 | 1.117 ± 0.153 | 1.022 ± 0.043 |
| | | 15 | 0.378 ± 0.022 | 0.526 ± 0.021 | 0.46 ± 0.04 | — | — |
| | | 3.4 | 0.668 ± 0.01 | 0.868 ± 0.026 | 0.917 ± 0.008 | — | — |
| | | 0.75 | 0.756 ± 0.003 | 1.135 ± 0.029 | 1.136 ± 0.128 | 1.757 ± 0.168 | 1.693 ± 0.101 |
| | | 0.17 | 1.347 ± 0.1 | 1.522 ± 0.022 | 1.56 ± 0.003 | — | — |
| | | 0.04 | 1.383 ± 0.015 | 1.641 ± 0.055 | 1.495 ± 0.063 | — | — |
| | | 0.01 | 1.877 ± 0.095 | 1.961 ± 0.056 | 1.844 ± 0.027 | 1.911 ± 0.019 | 1.623 ± 0.063 |
| | | 0.00 | 1.634 ± 0.072 | 1.652 ± 0.071 | 1.495 ± 0.014 | — | — |
| | Donor 2 | 68 | 0.231 ± 0.011 | 0.295 ± 0.03 | 0.34 ± 0.036 | 1.803 ± 0.209 | 1.881 ± 0.054 |
| | | 15 | 0.365 ± 0.063 | 0.511 ± 0.02 | 0.491 ± 0.018 | — | — |
| | | 3.4 | 0.628 ± 0.043 | 0.858 ± 0.004 | 0.848 ± 0.009 | — | — |
| | | 0.75 | 0.731 ± 0.056 | 1.18 ± 0.022 | 1.248 ± 0.018 | 2.098 ± 0.038 | 2.036 ± 0.034 |

TABLE 37-continued T-Cell inhibition by IgG-CDR3-Toxins. Comparing Long and Short Linkers.

| | | | | | |
|---|---|---|---|---|---|
| 0.17 | 1.264 ± 0.093 | 1.646 ± 0.052 | 1.776 ± 0.006 | — | — |
| 0.04 | 1.587 ± 0.012 | 1.878 ± 0.041 | 1.975 ± 0.056 | — | — |
| 0.01 | 1.973 ± 0.061 | 2.113 ± 0.035 | 2.117 ± 0.086 | 2.228 ± 0.023 | 2.066 ± 0.036 |
| 0.00 | 1.911 ± 0.017 | 1.867 ± 0.06 | 1.968 ± 0.069 | — | — |

T-cell growth and activation on same plate

| | | | BID: | BID # 48 VH4-34 MutE 3xG4S ShK | 61 VH4-34 MutE GG-ShK-GG | 55 VH4-34 MutE No Knob | Negative Control IgG |
|---|---|---|---|---|---|---|---|
| | | | [IgG] nM | | | | |
| IL-2 ELISA (A450) | Donor 1 | | 68 | 0.432 ± 0.01 | 0.46 ± 0.041 | 1.306 | 1.549 ± 0 |
| | | | 15 | 0.626 ± 0.011 | 0.697 ± 0.029 | — | — |
| | | | 3.4 | 0.752 ± 0.049 | 0.899 ± 0.003 | — | — |
| | | | 0.75 | 0.864 ± 0.032 | 1.246 ± 0.054 | 2.169 | 2.044 |
| | | | 0.17 | 1.332 ± 0.02 | 1.663 ± 0.122 | — | — |
| | | | 0.04 | 1.585 ± 0.038 | 1.906 ± 0.041 | — | — |
| | | | 0.01 | 1.931 ± 0.15 | 2.006 ± 0.063 | 2.228 | 2.154 |
| | | | 0.00 | 1.822 ± 0.007 | 1.81 ± 0.074 | — | — |
| | Donor 2 | | 68 | 0.378 ± 0.037 | 0.336 ± 0.027 | 0.934 | 1.367 |
| | | | 15 | 0.375 ± 0.007 | 0.4 ± 0.024 | — | — |
| | | | 3.4 | 0.454 ± 0.055 | 0.474 ± 0.017 | — | — |
| | | | 0.75 | 0.442 ± 0.035 | 0.612 ± 0.02 | 1.421 | 1.524 |
| | | | 0.17 | 0.615 ± 0.021 | 0.94 ± 0.069 | — | — |
| | | | 0.04 | 0.897 ± 0.021 | 1.338 ± 0.059 | — | — |
| | | | 0.01 | 1.306 ± 0.075 | 1.533 ± 0.09 | 1.752 | 1.482 |
| | | | 0.00 | 1.382 ± 0.018 | 1.431 ± 0.05 | — | — |
| TNF-α ELISA (A450) | Donor 1 | | 68 | 0.131 ± 0.029 | 0.179 ± 0.016 | 1.076 | 1.133 |
| | | | 15 | 0.309 ± 0.017 | 0.466 ± 0.03 | — | — |
| | | | 3.4 | 0.538 ± 0.047 | 0.766 ± 0.035 | — | — |
| | | | 0.75 | 0.661 ± 0.025 | 1.011 ± 0.037 | 1.672 | 1.647 |
| | | | 0.17 | 1.131 ± 0.055 | 1.371 ± 0.096 | — | — |
| | | | 0.04 | 1.25 ± 0.023 | 1.496 ± 0.034 | — | — |
| | | | 0.01 | 1.699 ± 0.037 | 1.766 ± 0.039 | 1.878 | 1.662 |
| | | | 0.00 | 1.537 ± 0 | 1.475 ± 0.026 | — | — |
| | Donor 2 | | 68 | 0.19 ± 0.022 | 0.228 ± 0.009 | 1.32 | 1.537 |
| | | | 15 | 0.336 ± 0.017 | 0.44 ± 0.013 | — | — |
| | | | 3.4 | 0.524 ± 0.093 | 0.615 ± 0.018 | — | — |
| | | | 0.75 | 0.615 ± 0.032 | 0.907 ± 0.043 | 1.875 | 1.855 |
| | | | 0.17 | 1.023 ± 0.063 | 1.45 ± 0.043 | — | — |
| | | | 0.04 | 1.324 ± 0.053 | 1.758 ± 0.021 | — | — |
| | | | 0.01 | 1.872 ± 0.04 | 1.971 ± 0.017 | 2.103 | 1.766 |
| | | | 0.00 | 1.667 ± 0.064 | 1.724 ± 0.043 | — | — |

T-cell growth and activation on same plate

TABLE 38

T-Cell inhibition by IgG-CDR3-Toxins: intermediate linker lengths

| | | [IgG] nM | BID # 56 VH4-34 MutE 1xG4S ShK | 65 VH4-34 MutE GSGG-Shk-GGGG | 66 VH4-34 MutE GGGG-Shk-GGGG | 67 VH4-34 MutE GGG-Shk-GGG | 61 VH4-34 MutE GG-ShK-GG |
|---|---|---|---|---|---|---|---|
| IL-2 ELISA (A450) | Donor 1 | 100 | — | 0.009 ± 0.002 | 0.019 ± 0.013 | 0.019 ± 0.001 | 0.032 ± 0.005 |
| | | 22 | 0.025 ± 0.012 | 0.011 ± 0.001 | 0.03 ± 0.01 | 0.034 ± 0.007 | 0.04 ± 0.004 |
| | | 4.9 | 0.018 ± 0.002 | 0.019 ± 0.009 | 0.032 ± 0.018 | 0.03 ± 0.018 | 0.038 ± 0.001 |
| | | 1.10 | 0.04 ± 0.006 | 0.019 ± 0.009 | 0.05 ± 0.014 | 0.051 ± 0.012 | 0.044 ± 0.011 |
| | | 0.24 | 0.068 ± 0 | 0.083 ± 0.035 | 0.099 ± 0.007 | 0.075 ± 0.029 | 0.06 ± 0.001 |
| | | 0.05 | 0.121 ± 0.027 | 0.12 ± 0.027 | 0.142 ± 0.013 | 0.106 ± 0.03 | 0.105 ± 0.003 |
| | | 0.01 | 0.171 ± 0.017 | 0.179 ± 0.01 | 0.174 ± 0.033 | 0.155 ± 0.019 | 0.136 ± 0.037 |
| | | 0.00 | 0.158 ± 0.013 | 0.119 ± 0.031 | 0.146 ± 0.024 | 0.18 ± 0.021 | — |
| | Donor 2 | 100 | — | 0.038 ± 0.04 | 0.011 ± 0.013 | 0.018 ± 0.002 | 0.016 ± 0.003 |
| | | 22 | 0.038 ± 0.016 | 0.028 ± 0.019 | 0.035 ± 0.018 | 0.044 ± 0.009 | 0.048 ± 0.017 |
| | | 4.9 | 0.061 ± 0.007 | 0.045 ± 0.01 | 0.051 ± 0.01 | 0.053 ± 0 | 0.059 ± 0.022 |
| | | 1.10 | 0.07 ± 0.001 | 0.056 ± 0.001 | 0.077 ± 0.022 | 0.072 ± 0.001 | 0.074 ± 0.012 |
| | | 0.24 | 0.108 ± 0.014 | 0.116 ± 0.003 | 0.131 ± 0.018 | 0.113 ± 0.006 | 0.123 ± 0.02 |
| | | 0.05 | 0.159 ± 0.016 | 0.163 ± 0.014 | 0.193 ± 0.001 | 0.155 ± 0.026 | 0.165 ± 0.017 |
| | | 0.01 | 0.21 ± 0.023 | 0.22 ± 0.001 | 0.224 ± 0.019 | 0.213 ± 0.023 | 0.22 ± 0.019 |
| | | 0.00 | 0.188 ± 0.032 | 0.185 ± 0.008 | 0.183 ± 0.005 | 0.189 ± 0.001 | — |

TABLE 38-continued

T-Cell inhibition by IgG-CDR3-Toxins: intermediate linker lengths

| | | | BID # | | | | |
|---|---|---|---|---|---|---|---|
| | | | 56 VH4-34 MutE 1xG4S ShK | 65 VH4-34 MutE GSGG-Shk-GGGG | 66 VH4-34 MutE GGGG-Shk-GGGG | 67 VH4-34 MutE GGG-Shk-GGG | 61 VH4-34 MutE GG-ShK-GG |
| | | [IgG] nM | | | | | |
| TNF-α ELISA (A450) | Donor 1 | 100 | — | 0.059 ± 0.015 | 0.069 ± 0.023 | 0.073 ± 0 | 0.091 ± 0.005 |
| | | 22 | 0.214 ± 0.006 | 0.169 ± 0.039 | 0.191 ± 0.028 | 0.151 ± 0.013 | 0.216 ± 0.006 |
| | | 4.9 | 0.245 ± 0.083 | 0.361 ± 0.138 | 0.315 ± 0.017 | 0.23 ± 0.026 | 0.298 ± 0.042 |
| | | 1.10 | 0.481 ± 0.003 | 0.462 ± 0.018 | 0.566 ± 0.011 | 0.487 ± 0.019 | 0.509 ± 0.051 |
| | | 0.24 | 0.786 ± 0.049 | 0.958 ± 0.169 | 0.96 ± 0.01 | 0.755 ± 0.116 | 0.819 ± 0.143 |
| | | 0.05 | 1.231 ± 0.032 | 1.248 ± 0.128 | 1.309 ± 0.025 | 1.093 ± 0.019 | 1.266 ± 0.014 |
| | | 0.01 | 1.433 ± 0.079 | 1.497 ± 0.014 | 1.489 ± 0.07 | 1.402 ± 0.064 | 1.448 ± 0.031 |
| | | 0.00 | 1.322 ± 0.035 | 1.22 ± 0.071 | 1.339 ± 0.079 | 1.414 ± 0.009 | — |
| | Donor 2 | 100 | — | 0.031 ± 0.005 | 0.045 ± 0.006 | 0.062 ± 0.002 | 0.036 ± 0.003 |
| | | 22 | 0.315 ± 0.026 | 0.273 ± 0.022 | 0.315 ± 0.01 | 0.303 ± 0.001 | 0.258 ± 0.026 |
| | | 4.9 | 0.545 ± 0.056 | 0.58 ± 0.032 | 0.616 ± 0.094 | 0.515 ± 0.046 | 0.512 ± 0.042 |
| | | 1.10 | 0.845 ± 0.021 | 0.812 ± 0.001 | 0.902 ± 0.06 | 0.785 ± 0.028 | 0.791 ± 0.031 |
| | | 0.24 | 1.049 ± 0.027 | 1.181 ± 0.08 | 1.084 ± 0.052 | 0.985 ± 0.067 | 0.996 ± 0.023 |
| | | 0.05 | 1.198 ± 0.048 | 1.192 ± 0.022 | 1.305 ± 0.029 | 1.237 ± 0.053 | 1.201 ± 0.083 |
| | | 0.01 | 1.336 ± 0.087 | 1.378 ± 0.051 | 1.38 ± 0.009 | 1.327 ± 0.078 | 1.318 ± 0.017 |
| | | 0.00 | 1.212 ± 0.094 | 1.193 ± 0.015 | 1.192 ± 0.018 | 1.198 ± 0.097 | — |

Example 26

Antibodies comprising an ultralong CDR3, including an ultralong CDR that comprises a non-antibody sequence, may be evaluated by any method known in the art (e.g., via Kv1.3 inhibition assays).

Kv1.3 inhibition by toxins in CDR3 of IgGs was assessed directly from PBMCs, without purifying T-cells. PBMCs were enriched as described in example 16, but not subjected to T-cell purification. The assay for T-cell inhibition using PBMCs was carried out as it was for purified T-cells in Example 16, with the modification that 1×10^5 PBMCs are dispensed per well. Cell were treated with Toxin CDR3 IgGs VH4-34 MutE 3xG4S ShK (BID48 of FIGS. 21 and 22), VH4-34 MutE GGG-Shk-GGG (BID067 of FIGS. 21 and 22), and VH4-34 MutE G-ShK-G (BID 60 of FIGS. 21 and 22) as described in Example 16. PBMC supernatants were evaluated for Granzyme B and IL-17 by ELISA. IL-17 was detected using Human IL-17 ELISA Ready-SET-Go! (eBioscience Catalog #: 88-7176-22). Granzyme B was detected using Capture Antibody: BD NA/LE Purified Anti-Human Granzyme B. Catalog #: 51-9005687, Detection Antibody: BD Biotinylated Anti-Human Granzyme B. Catalog #: 51-9000060, and Avidin-HRP: BD Streptavidin-HRP. Catalog #: 51-9000209, used per manufacturer directions with modifications for 384 well format. The results of these inhibition assays are tabulated in Table 39.

TABLE 39

T-Cell inhibition by IgG-CDR3-Toxins assayed via Granzyme B and IL-17

| | | | BID # | | | |
|---|---|---|---|---|---|---|
| | | | 75 VH4-34 MutE 3xG4S ShK | 76 VH4-34 MutE G-ShK-G | 77 VH4-34 MutE GGG-Shk-GGG | 61 VH4-34 MutE GG-ShK-GG |
| | | [IgG] nM | | | | |
| Granzyme B ELISA (A450) | Donor 1 | 68 | 0.023 ± 0.004 | 0.03 ± 0.004 | 0.03 ± 0.007 | 0.837 ± 0.217 |
| | | 17 | 0.059 ± 0.041 | 0.105 ± 0.012 | 0.166 ± 0.026 | — |
| | | 4.2 | 0.94 ± 0.155 | 0.756 ± 0.14 | 1.057 ± 0.128 | 1.579 ± 0.01 |
| | | 1.06 | 1.435 ± 0.068 | 1.448 ± 0.069 | 1.481 ± 0.059 | — |
| | | 0.26 | 1.61 ± 0.079 | 1.615 ± 0.043 | 1.657 ± 0.013 | 1.602 ± 0.06 |
| | | 0.07 | 1.642 ± 0.03 | 1.635 ± 0.058 | 1.644 ± 0.003 | — |
| | | 0.02 | 1.665 ± 0.044 | 1.646 ± 0.037 | 1.644 ± 0.024 | 1.563 ± 0.065 |
| | | 0.00 | 1.652 ± 0.054 | 1.61 ± 0.034 | 1.557 ± 0.06 | — |
| | Donor 2 | 68 | 0.02 ± 0.009 | 0.026 ± 0.005 | 0.028 ± 0.006 | 0.445 ± 0.041 |
| | | 17 | 0.014 ± 0.001 | 0.034 ± 0.015 | 0.038 ± 0.011 | — |
| | | 4.2 | 0.429 ± 0.059 | 0.308 ± 0.023 | 0.721 ± 0.091 | 1.478 ± 0.022 |
| | | 1.1 | 1.286 ± 0.015 | 1.269 ± 0.039 | 1.366 ± 0.042 | — |
| | | 0.26 | 1.43 ± 0.082 | 1.464 ± 0.02 | 1.42 ± 0.061 | 1.495 ± 0.076 |
| | | 0.07 | 1.454 ± 0.034 | 1.507 ± 0.035 | 1.494 ± 0.005 | — |
| | | 0.02 | 1.545 ± 0.036 | 1.541 ± 0.05 | 1.492 ± 0.027 | 1.488 ± 0.069 |
| | | 0.00 | 1.553 ± 0.075 | 1.507 ± 0.042 | 1.494 ± 0.024 | — |
| IL-17 ELISA (A450) | Donor 1 | 68 | 0.019 ± 0.002 | 0.02 ± 0.005 | 0.023 ± 0.007 | 0.131 ± 0.024 |
| | | 17 | 0.008 ± 0.003 | 0.028 ± 0.011 | 0.034 ± 0.012 | — |
| | | 4.2 | 0.115 ± 0.023 | 0.088 ± 0.005 | 0.122 ± 0.05 | 0.456 ± 0.045 |
| | | 1.1 | 0.263 ± 0.046 | 0.324 ± 0.058 | 0.388 ± 0.024 | — |
| | | 0.26 | 0.361 ± 0.058 | 0.474 ± 0.052 | 0.53 ± 0.075 | 0.474 ± 0.055 |
| | | 0.07 | 0.348 ± 0.064 | 0.514 ± 0.077 | 0.451 ± 0.031 | — |
| | | 0.02 | 0.505 ± 0.057 | 0.545 ± 0.028 | 0.492 ± 0.142 | 0.474 ± 0.101 |
| | | 0.00 | 0.45 ± 0.04 | 0.466 ± 0.053 | 0.375 ± 0.079 | — |

TABLE 39-continued

T-Cell inhibition by IgG-CDR3-Toxins assayed via Granzyme B and IL-17

| | [IgG] nM | 75 VH4-34 MutE 3xG4S ShK | 76 VH4-34 MutE G-ShK-G | 77 VH4-34 MutE GGG-Shk-GGG | 61 VH4-34 MutE GG-ShK-GG |
|---|---|---|---|---|---|
| | | | | BID # | |
| Donor 2 | 68 | 0.017 ± 0.007 | 0.024 ± 0.001 | 0.02 ± 0.004 | 0.236 ± 0.012 |
| | 17 | 0.013 ± 0.003 | 0.034 ± 0.006 | 0.035 ± 0.013 | — |
| | 4.2 | 0.17 ± 0.042 | 0.122 ± 0.012 | 0.247 ± 0.02 | 0.854 ± 0.061 |
| | 1.1 | 0.532 ± 0.013 | 0.572 ± 0.077 | 0.558 ± 0.023 | — |
| | 0.26 | 0.608 ± 0.087 | 0.716 ± 0.046 | 0.673 ± 0.041 | 0.783 ± 0.033 |
| | 0.07 | 0.679 ± 0.053 | 0.755 ± 0.066 | 0.692 ± 0.058 | — |
| | 0.02 | 0.912 ± 0.102 | 0.908 ± 0.094 | 0.833 ± 0.037 | 0.825 ± 0.052 |
| | 0.00 | 0.8 ± 0.01 | 0.809 ± 0.047 | 0.75 ± 0.009 | — |

Example 27

Antibodies comprising an ultralong CDR3, including an ultralong CDR that comprises a non-antibody sequence, may be evaluated by any method known in the art (e.g., via T-cell activation or inhibition assays).

The ability to inhibit T-cell activation was compared among several versions of IgG VH4-34 ShK with point mutations in the ShK toxin sequence at position 21 in ShK (SEQ ID NO: 648). Point mutations were generated using an overlap PCR method to modify the ShK sequence in VH4-34 MutE 3xG4S ShK (BID48 of FIG. 21), yielding VH4-34 MutE 3xG4S ShK(M21Q) (BID105 of FIG. 21), VH4-34 MutE 3xG4S ShK(M21L) (BID106 of FIG. 21), VH4-34 MutE 3xG4S ShK(M21F) (BID107 of FIG. 21), VH4-34 MutE 3xG4S ShK(M21I) (BID108 of FIG. 21), and VH4-34 MutE 3xG4S ShK(M21A) (BID109 of FIG. 21). These heavy chains encoding ShK mutations were paired with light chain VL1-51 S2A T5N P8S A12G A13S P14L K46R L47T D51G N52D N53LK (SEQ ID NO: 486, see FIG. 22) for large scale transfection as described in Example 4, and purified as described in Example 6 and 14. The resultant IgGs were tested with VH4-34 MutE 3xG4S (BID 48 of FIGS. 21 and 22) and VH4-34 MutE 3xGGS NoKnob IgG (BID55 of FIGS. 21 and 22) as positive and negative controls. T-cell inhibition was examined using PBMCs as described in Example 26 with the modification that cells were incubated 48 hours rather than 24 hours prior to harvest of supernatant. ELISAs to detect TNF-alpha and IL-17 were carried out using Human IL-17 ELISA Ready-SET-Go! (eBioscience Catalog #: 88-7176-22) and Human TNFα ELISA Ready-SET-Go!(eBioscience Catalog #: 88-7346-22) following manufacturer instructions with modification for 384 well assay. These results are shown in Table 40.

TABLE 40

Mutations to ShK Residue M21 in VH4-34 MutE CDR3.

| | | [IgG] nM | BID # 102 VH4-34 MutE No Knob | 80 VH4-34 MutE 3xG4S ShK | 105 VH4-34 MutE 3xG4S ShK (M21Q) | 106 VH4-34 MutE 3xG4S ShK (M21L) | 107 VH4-34 MutE 3xG4S ShK (M21F) | 108 VH4-34 MutE 3xG4S ShK (M21I) | 109 VH4-34 MutE 3xG4S ShK (M21A) |
|---|---|---|---|---|---|---|---|---|---|
| IL-17 ELISA (A450) | Donor 1 | 140 | 0.247 ± 0.128 | 0.02 ± 0.002 | 0.058 ± 0.002 | 0.123 ± 0.02 | 0.53 ± 0.01 | 0.078 ± 0.012 | 0.068 ± 0.003 |
| | | 31 | 0.453 ± 0.088 | 0.022 ± 0 | 0.541 ± 0.184 | 0.621 ± 0.167 | 1.114 ± 0.15 | 0.843 ± 0.068 | 0.665 ± 0.04 |
| | | 6.9 | 0.828 ± 0.024 | 0.641 ± 0.014 | 0.835 ± 0.024 | 0.786 ± 0.074 | 1.279 ± 0.215 | 1.28 ± 0.024 | 1.13 ± 0.031 |
| | | 1.54 | 1.183 ± 0.05 | 1.063 ± 0.045 | 1.216 ± 0.108 | 1.242 ± 0.071 | 1.294 ± 0.012 | 1.303 ± 0.049 | 1.326 ± 0.061 |
| | | 0.34 | 1.271 ± 0.015 | 1.417 ± 0.058 | 1.078 ± 0.322 | 1.257 ± 0.004 | 1.06 ± 0.397 | 1.237 ± 0.018 | 1.295 ± 0.078 |
| | | 0.08 | 1.338 ± 0.14 | 1.335 ± 0.051 | 1.369 ± 0.09 | 1.141 ± 0.406 | 1.054 ± 0.285 | 1.237 ± 0.042 | 1.194 ± 0.093 |
| | | 0.02 | 1.348 ± 0.071 | 1.261 ± 0.075 | 1.375 ± 0.02 | 1.161 ± 0.33 | 1.039 ± 0.091 | 0.96 ± 0.016 | 0.944 ± 0.07 |
| | | 0.00 | 0 ± 0.192 | 1.079 ± 0.077 | 1.069 ± 0.089 | 1.261 ± 0.208 | 0.993 ± 0.011 | 1.09 ± 0.007 | 1.05 ± 0.014 |
| | Donor 2 | 140 | 0.096 ± 0.07 | 0.032 ± 0.005 | 0.048 ± 0.008 | 0.052 ± 0.005 | 0.278 ± 0.029 | 0.047 ± 0.004 | 0.043 ± 0.014 |
| | | 31 | 0.364 ± 0.054 | 0.033 ± 0.012 | 0.27 ± 0.015 | 0.278 ± 0.044 | 0.602 ± 0.224 | 0.335 ± 0.005 | 0.219 ± 0.019 |
| | | 6.9 | 0.641 ± 0.01 | 0.281 ± 0.038 | 0.707 ± 0.092 | 0.595 ± 0.028 | 0.647 ± 0.229 | 0.614 ± 0.061 | 0.592 ± 0.092 |
| | | 1.54 | 0.785 ± 0.024 | 0.785 ± 0.013 | 0.924 ± 0.022 | 0.795 ± 0.267 | 0.597 ± 0.22 | 0.733 ± 0.052 | 0.711 ± 0.009 |
| | | 0.34 | 0.82 ± 0.018 | 0.757 ± 0.058 | 0.859 ± 0.089 | 0.861 ± 0.066 | 0.765 ± 0.241 | 0.744 ± 0.241 | 0.897 ± 0.044 |
| | | 0.08 | 0.777 ± 0.137 | 0.772 ± 0.069 | 0.778 ± 0.012 | 0.654 ± 0.221 | 0.879 ± 0.013 | 0.91 ± 0.044 | 0.918 ± 0.054 |
| | | 0.02 | 0.959 ± 0.105 | 0.977 ± 0.052 | 1.022 ± 0.022 | 0.937 ± 0.259 | 0.831 ± 0.181 | 0.896 ± 0.061 | 0.984 ± 0.013 |
| | | 0.00 | 0 ± 0.002 | 1.03 ± 0.053 | 1.099 ± 0.003 | 1.107 ± 0.092 | 0.797 ± 0.11 | 0.836 ± 0.036 | 0.923 ± 0.063 |
| TNF-α ELISA (A450) | Donor 1 | 140 | 0.402 ± 0.152 | 0.024 ± 0.003 | 0.053 ± 0.008 | 0.164 ± 0.036 | 1.079 ± 0.277 | 0.074 ± 0.012 | 0.056 ± 0.008 |
| | | 31 | 0.808 ± 0.127 | 0.036 ± 0.007 | 1.48 ± 0.007 | 1.515 ± 0.089 | 1.494 ± 0.16 | 1.506 ± 0.006 | 1.473 ± 0.053 |
| | | 6.9 | 1.096 ± 0.075 | 1.624 ± 0.105 | 1.799 ± 0.041 | 1.762 ± 0.024 | 1.616 ± 0.155 | 1.854 ± 0.019 | 1.957 ± 0.062 |
| | | 1.54 | 1.334 ± 0.12 | 1.734 ± 0.082 | 1.69 ± 0.171 | 1.575 ± 0.087 | 1.466 ± 0.046 | 1.604 ± 0.009 | 1.696 ± 0.086 |
| | | 0.34 | 1.416 ± 0.074 | 1.542 ± 0.01 | 1.473 ± 0.013 | 1.495 ± 0.033 | 1.448 ± 0.008 | 1.591 ± 0.076 | 1.581 ± 0.004 |
| | | 0.08 | 1.451 ± 0.001 | 1.059 ± 0.281 | 1.26 ± 0.179 | 1.462 ± 0.045 | 1.389 ± 0.041 | 1.399 ± 0.019 | 1.397 ± 0.131 |
| | | 0.02 | 1.518 ± 0.123 | 1.188 ± 0.067 | 1.396 ± 0.11 | 1.493 ± 0.05 | 1.1 ± 0.036 | 1.384 ± 0.04 | 1.371 ± 0.06 |
| | | 0.00 | 0 ± 0.012 | 1.306 ± 0.082 | 1.408 ± 0.059 | 1.337 ± 0.079 | 1.241 ± 0.082 | 1.388 ± 0.065 | 1.379 ± 0.052 |
| | Donor 2 | 140 | 0.167 ± 0.064 | 0.035 ± 0.013 | 0.036 ± 0.01 | 0.046 ± 0.001 | 0.942 ± 0.038 | 0.056 ± 0.007 | 0.042 ± 0.005 |
| | | 31 | 0.438 ± 0 | 0.035 ± 0.001 | 0.733 ± 0.016 | 0.726 ± 0.062 | 1.504 ± 0.102 | 1.028 ± 0.046 | 0.63 ± 0.044 |
| | | 6.9 | 0.916 ± 0.004 | 0.953 ± 0.063 | 1.667 ± 0.052 | 1.623 ± 0.001 | 1.512 ± 0.219 | 1.777 ± 0 | 1.764 ± 0.014 |
| | | 1.54 | 1.293 ± 0.029 | 1.655 ± 0.023 | 1.749 ± 0.06 | 1.768 ± 0.038 | 1.423 ± 0.004 | 1.579 ± 0.065 | 1.715 ± 0.009 |

TABLE 40-continued Mutations to ShK Residue M21 in VH4-34 MutE CDR3.

| | BID # | | | | | | |
|---|---|---|---|---|---|---|---|
| [IgG] nM | 102 VH4-34 MutE No Knob | 80 VH4-34 MutE 3xG4S ShK | 105 VH4-34 MutE 3xG4S ShK (M21Q) | 106 VH4-34 MutE 3xG4S ShK (M21L) | 107 VH4-34 MutE 3xG4S ShK (M21F) | 108 VH4-34 MutE 3xG4S ShK (M21I) | 109 VH4-34 MutE 3xG4S ShK (M21A) |
| 0.34 | 1.55 ± 0.13 | 1.586 ± 0.05 | 1.662 ± 0.041 | 1.661 ± 0.029 | 1.567 ± 0.009 | 1.597 ± 0.021 | 1.683 ± 0.003 |
| 0.08 | 1.424 ± 0.092 | 1.36 ± 0.049 | 1.433 ± 0.064 | 1.501 ± 0.01 | 1.523 ± 0.097 | 1.56 ± 0.045 | 1.599 ± 0.015 |
| 0.02 | 1.562 ± 0.109 | 1.483 ± 0.045 | 1.578 ± 0.018 | 1.57 ± 0.05 | 1.616 ± 0.05 | 1.623 ± 0.001 | 1.67 ± 0.022 |
| 0.00 | 0 ± 0.003 | 1.427 ± 0.009 | 1.626 ± 0.006 | 1.667 ± 0.053 | 1.49 ± 0.035 | 1.518 ± 0.059 | 1.576 ± 0.027 |

For the disclosure herein, the very least, and not as an attempt to limit the application of the doctrine of equivalents to the scope of the claims, each numerical parameter should at least be construed in light of the number of reported significant digits and by applying ordinary rounding techniques. Notwithstanding that the numerical ranges and parameters setting forth the broad scope of the disclosure are approximations, the numerical values set forth in the specific examples are reported as precisely as possible. Any numerical value, however, inherently contains certain errors necessarily resulting from the standard deviation found in their respective testing measurements.

The terms "a," "an," "the" and similar referents used in the context of describing the exemplary embodiments (especially in the context of the following claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein is intended merely to better illuminate the exemplary embodiments and does not pose a limitation on the scope of the exemplary embodiments otherwise claimed. No language in the specification should be construed as indicating any non-claimed element essential to the practice of the exemplary embodiments.

Groupings of alternative elements or embodiments disclosed herein are not to be construed as limitations. Each group member can be referred to and claimed individually or in any combination with other members of the group or other elements found herein. It is anticipated that one or more members of a group can be included in, or deleted from, a group for reasons of convenience and/or patentability. When any such inclusion or deletion occurs, the specification is deemed to contain the group as modified thus fulfilling the written description of all Markush groups used in the appended claims.

Certain embodiments are described herein, including the best mode known to the inventors for carrying out the exemplary embodiments. Of course, variations on these described embodiments will become apparent to those of ordinary skill in the art upon reading the foregoing description. The inventor expects skilled artisans to employ such variations as appropriate, and the inventors intend for the embodiments to be practiced otherwise than specifically described herein. Accordingly, this disclosure includes all modifications and equivalents of the subject matter recited in the claims appended hereto as permitted by applicable law. Moreover, any combination of the above-described elements in all possible variations thereof is encompassed by the disclosure unless otherwise indicated herein or otherwise clearly contradicted by context.

Furthermore, numerous references have been made to patents and printed publications. Each of the above-cited references is individually incorporated herein by reference in their entirety.

Specific embodiments disclosed herein can be further limited in the claims using consisting of or and consisting essentially of language. When used in the claims, whether as filed or added per amendment, the transition term "consisting of" excludes any element, step, or ingredient not specified in the claims. The transition term "consisting essentially of" limits the scope of a claim to the specified materials or steps and those that do not materially affect the basic and novel characteristic(s). Exemplary embodiments so claimed are inherently or expressly described and enabled herein.

In closing, it is to be understood that the exemplary embodiments disclosed herein are illustrative of the principles of the present disclosure. Other modifications that can be employed are within the scope of the disclosure. Thus, by way of example, but not of limitation, alternative configurations of the present exemplary embodiments can be utilized in accordance with the teachings herein. Accordingly, the present exemplary embodiments are not limited to that precisely as shown and described.

SEQUENCE LISTING (959 sequences)

SEQ ID NO: 1 - protein, 6 aa, Artificial sequence
  Synthesized: VH sequence (germline, BLV5B8, BLV8C11, BF4E9, and F18)
CTTVHQ

SEQ ID NO: 2 - protein, 6 aa, Artificial sequence
  Synthesized: VH sequence (BLV1H12)
CTSVHQ

SEQ ID NO: 3 - protein, 6 aa, Artificial sequence
  Synthesized: VH sequence (BLV5D3)
CSSVTQ

SEQ ID NO: 4 - protein, 6 aa, Artificial sequence
  Synthesized: VH sequence (BF1H1)
CTTVHP

SEQ ID NO: 5 - protein, 48 aa, Artificial sequence
  Synthesized: Germline sequence derived from DH2 gene
SCPDGYSYGYGCGYGYGCSGYDCYGYGGYGGYGGYGYSSYSYSYTYEY

SEQ ID NO: 6 - protein, 48 aa, Artificial sequence
  Synthesized: Sequence derived from DH gene (BLV1H12)
SCPDGYRERSDCSNRPACGTSDCCRVSVFGNCLTTLPVSYSYTYNYEW

SEQ ID NO: 7 - protein, 44 aa, Artificial sequence
  Synthesized: Sequence derived from DH gene (BLV5B8)
CSDGYIAVDSCGRGQSDGCVNDCNSCYYGWRNCRRQPAIHSYEF

SEQ ID NO: 8 - protein, 44 aa, Artificial sequence
  Synthesized: Sequence derived from DH gene (BLV5D3)
SCPDGCSDGDGCVDGCCCSAYRCYTPGVRDLSCTSYSITYTYEW

SEQ ID NO: 9 - protein, 45 aa, Artificial sequence
  Synthesized: Sequence derived from DH gene (BLV8C11)
CCSDAYRYDSGCGSGCDCCGADCYVFGACTFGLDSSYSYIYIYQW

SEQ ID NO: 10 - protein, 47 aa, Artificial sequence
  Synthesized: Sequence derived from DH gene (BF4E9)
CPDGYSYGYGCGYGYGCSGYDCYGYGGYGYGGYGGYSSYSYSYSYEY

SEQ ID NO: 11 - protein, 44 aa, Artificial sequence
  Synthesized: Sequence derived from DH gene (BF1H1)
SPDGYSYGYGCGYGYGCSGYDCYGYGGYGYGGYGGYSSYSYSYS

SEQ ID NO: 12 - protein, 42 aa, Artificial sequence
  Synthesized: Sequence derived from DH gene (F18)
CPDGYGYGYGCGYGSYGYSGYDCYGYGGYGGYGGYGGYSSYS

SEQ ID NO: 13 - protein, 15 aa, Artificial sequence
  Synthesized: Germline sequence derived from JH1 gene
YVDAWGQGLLVTVSS

SEQ ID NO: 14 - protein, 15 aa, Artificial sequence
  Synthesized: Sequence derived from JH gene (BLV1H12)
HVDVWGQGLLVTVSS

SEQ ID NO: 15 - protein, 15 aa, Artificial sequence
  Synthesized: Sequence derived from JH gene (BLV5B8)
HVDAWGRGLLVTVSS

SEQ ID NO: 16 - protein, 15 aa, Artificial sequence
  Synthesized: Sequence derived from JH gene (BLV5D3)
NVDAWGRGLLVTVSS

SEQ ID NO: 17 - protein, 15 aa, Artificial sequence
  Synthesized: Sequence derived from JH gene (BLV8C11 or BF4E9)
YGDAWGQGLLVTVSS

SEQ ID NO: 18 - protein, 6 aa, Artificial sequence
  Synthesized: Sequence derived from CDR3 (BLV1H12)
ETKKYQ

SEQ ID NO: 19 - protein, 5 aa, Artificial sequence
  Synthesized: Sequence derived from CDR3 (BLV5B8)
ETRKT

SEQ ID NO: 20 - protein, 6 aa, Artificial sequence
  Synthesized: Sequence derived from CDR3 (BLV5D3)
RTHVSR

SEQ ID NO: 21 - protein, 6 aa, Artificial sequence
  Synthesized: Sequence derived from CDR3 (BLV8C11)
KTTRKT

SEQ ID NO: 22 - protein, 61 aa, Artificial sequence
  Synthesized: ultralong CDR3 sequence (BLV1H12)
SVHQETKKYQSCPDGYRERSDCSNRPACGTSDCCRVSVFGNCLTTLPVSYSYTYNYEWHVD

SEQ ID NO: 23 - protein, 56 aa, Artificial sequence
  Synthesized: ultralong CDR3 sequence (BLV5B8)
TVHQETRKTCSDGYIAVDSCGRGQSDGCVNDCNSCYYGWRNCRRQPAIHSYEFHVD

SEQ ID NO: 24 - protein, 57 aa, Artificial sequence
  Synthesized: ultralong CDR3 sequence (BLV5D3)
SVTQRTHVSRSCPDGCSDGDGCVDGCCCSAYRCYTPGVRDLSCTSYSITYTYEWNVD

SEQ ID NO: 25 - protein, 58 aa, Artificial sequence
  Synthesized: ultralong CDR3 sequence (BLV8C11)
TVHQKTTRKTCCSDAYRYDSGCGSGCDCCGADCYVFGACTFGLDSSYSYIYIYQWYVD

SEQ ID NO: 26 - protein, 56 aa, Artificial sequence
  Synthesized: ultralong CDR3 sequence (BF4E9)
TVHQIFCPDGYSYGYGCGYGYGCSGYDCYGYGGYGYGGYGGYSSYSYSYSYEYYGD

SEQ ID NO: 27 - protein, 48 aa, Artificial sequence
  Synthesized: ultralong CDR3 sequence (BF1H1)
TVHPSPDGYSYGYGCGYGYGCSGYDCYGYGGYGYGGYGGYSSYSYSYS

SEQ ID NO: 28 - protein, 48 aa, Artificial sequence
  Synthesized: ultralong CDR3 sequence (F18)
TVHQIRCPDGYGYGYGCGYGSYGYSGYDCYGYGGYGGYGGYGGYSSYS

SEQ ID NO: 29 - protein, 100 aa, Artificial sequence
  Synthesized: exemplary heavy chain variable region sequence suitable for modification or use with an ultralong CDR3 sequence (VH-UL)
QVQLRESGPSLVKPSQTLSLTCTASGFSLSDKAVGWVRQAPGKALEWLGGIDTGGSTGYNPGLKSRLSITKDNSKSQVSLSVSSVTTEDSATYYCTTVHQ

SEQ ID NO: 30 - protein, 97 aa, Artificial sequence
  Synthesized: exemplary light chain variable region sequence suitable for modification or use with an ultralong CDR3 sequence (VL1X)
QAVLTQPSSVSGSLGQRVSITCSGSSSNVGNGYVSWYQLIPGSAPRTLIYGDTSRASGVPDRFSGSRSGNTATLTISSLQAEDEADYFCASAEDSSS

SEQ ID NO: 31 - protein, 99 aa, Artificial sequence
  Synthesized: exemplary heavy chain variable region sequence suitable for modification or use with an ultralong CDR 3 sequence (VH4-39)
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAR

SEQ ID NO: 32 - protein, 96 aa, Artificial sequence
  Synthesized: Human germline heavy chain variable region sequence 4-59*03
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCA

SEQ ID NO: 33 - protein, 97 aa, Artificial sequence
  Synthesized: Human germline heavy chain variable region sequence 4-34*02
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAR

SEQ ID NO: 34 - protein, 97 aa, Artificial sequence
  Synthesized: Human germline heavy chain variable region sequence 4-34*09
QVQLQESGPGLVKPSQTLSLTCAVYGGSFSGYYWSWIRQPPGKGLEWIGEINHSGSTNYNPSLKSRVTISVDTSKNQFSLKLSSVTAADTAVYYCAR

SEQ ID NO: 35 - protein, 110 aa, Artificial sequence
  Synthsized: Bovine light chain variable region sequence BLV1H12
QAVLNQPSSVSGSLGQRVSITCSGSSSNVGNGYVSWYQLIPGSAPRTLIYGDTSRASGVPDRFSGSRSGNTATLTISSLQAEDEADYFCASAEDSSSNAVFGSGTTLTVL

SEQ ID NO: 36 - protein, 98 aa, Artificial sequence
  Synthesized: Human germline light chain variable region sequence VL1-47
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSG

SEQ ID NO: 37 - protein, 99 aa, Artificial sequence
  Synthesized: Human germline light chain variable region sequence VL1-40*1
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSG

SEQ ID NO: 38 - protein, 98 aa, Artificial sequence
  Synthesized: Human germline light chain variable region sequence VL1-51*01
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSA

SEQ ID NO: 39 - protein, 99 aa, Artificial sequence
  Synthesized: Human germline light chain variable region sequence VL2-18*02
QSALTQPPSVSGSPGQSVTISCTGTSSDVGSYNRVSWYQQPPGTAPKLMIYEVSNRPSGVPDRFSGSKSGNTASLTISGLQAEDEADYYCSSYTSSSTF

SEQ ID NO: 40 - protein, 4 aa, Artificial sequence
  Synthesized: optional sequence in ultralong CDR3
  MISC_FEATURE (1)..(1): X is threonine or serine
  MISC_FEATURE (3)..(3): X is histidine or threonine
  MISC_FEATURE (4)..(4): X is glutamine or proline
XVXX

SEQ ID NO: 41 - protein, 28 aa, Artificial sequence
  Synthesized: cysteine motif 1
  misc_feature (2)..(11): Xaa can be any naturally occurring amino acid
  misc_feature (13)..(17): Xaa can be any naturally occurring amino acid
  misc_feature (19)..(19): Xaa can be any naturally occurring amino acid
  misc_feature (21)..(27): Xaa can be any naturally occurring amino acid
CXXXXXXXXXXCXXXXXCXCXXXXXXXC

SEQ ID NO: 42 - protein, 43 aa, Artificial sequence
  Synthesized: cysteine motif 2
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(42): Xaa can be any naturally occurring amino acid
CXXXXXXXXXXCXXXXXXCXXXXXCXCXXXXXXXXXXXXXXXC

SEQ ID NO: 43 - protein, 21 aa, Artificial sequence
  Synthesized: cysteine motif 3
  misc_feature (2)..(12): Xaa can be any naturally occurring amino acid
  misc_feature (14)..(14): Xaa can be any naturally occurring amino acid
  misc_feature (16)..(20): Xaa can be any naturally occurring amino acid
CXXXXXXXXXXXCXCXXXXXC

SEQ ID NO: 44 - protein, 35 aa, Artificial sequence
  Synthesized: cysteine motif 4
  misc_feature (2)..(12): Xaa can be any naturally occurring amino acid
  misc_feature (14)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(34): Xaa can be any naturally occurring amino acid
CXXXXXXXXXXXCXXXXXCXXXXXCXCXXXXXXXC

SEQ ID NO: 45 - protein, 41 aa, Artificial sequence
  Synthesized: cysteine motif 5
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(40): Xaa can be any naturally occurring amino acid
CXXXXXXXXXXCXXXXXXCXXXXXCXCXXXXXXXXXXXXXC

SEQ ID NO: 46 - protein, 34 aa, Artificial sequence
  Synthesized: cysteine motif 6
  misc_feature (2)..(11): Xaa can be any naturally occurring amino acid
  misc_feature (13)..(17): Xaa can be any naturally occurring amino acid
  misc_feature (19)..(19): Xaa can be any naturally occurring amino acid
  misc_feature (21)..(24): Xaa can be any naturally occurring amino acid
  misc_feature (26)..(33): Xaa can be any naturally occurring amino acid
CXXXXXXXXXXCXXXXXCXCXXXXCXXXXXXXXC

SEQ ID NO: 47 - protein, 36 aa, Artificial sequence
  Synthesized: cysteine motif 7
  misc_feature (2)..(11): Xaa can be any naturally occurring amino acid
  misc_feature (13)..(18): Xaa can be any naturally occurring amino acid
  misc_feature (20)..(25): Xaa can be any naturally occurring amino acid
  misc_feature (27)..(27): Xaa can be any naturally occurring amino acid
  misc_feature (29)..(35): Xaa can be any naturally occurring amino acid
CXXXXXXXXXXCXXXXXXCXXXXXXCXCXXXXXXXC

SEQ ID NO: 48 - protein, 36 aa, Artificial sequence
  Synthesized: cysteine motif 8
  misc_feature (2)..(11): Xaa can be any naturally occurring amino acid
  misc_feature (13)..(16): Xaa can be any naturally occurring amino acid
  misc_feature (18)..(24): Xaa can be any naturally occurring amino acid
  misc_feature (26)..(26): Xaa can be any naturally occurring amino acid
  misc_feature (28)..(35): Xaa can be any naturally occurring amino acid
CXXXXXXXXXXCXXXXCXXXXXXXCXCXXXXXXXXC

SEQ ID NO: 49 - protein, 35 aa, Artificial sequence
  Synthesized: cysteine motif 9
  misc_feature (2)..(11): Xaa can be any naturally occurring amino acid
  misc_feature (13)..(16): Xaa can be any naturally occurring amino acid
  misc_feature (18)..(24): Xaa can be any naturally occurring amino acid
  misc_feature (26)..(26): Xaa can be any naturally occurring amino acid
  misc_feature (28)..(34): Xaa can be any naturally occurring amino acid
CXXXXXXXXXXCXXXXCXXXXXXXCXCXXXXXXXC

SEQ ID NO: 50 - protein, 33 aa, Artificial sequence
  Synthesized: cysteine motif 10
  misc_feature (2)..(14): Xaa can be any naturally occurring amino acid
  misc_feature (16)..(23): Xaa can be any naturally occurring amino acid
  misc_feature (25)..(32): Xaa can be any naturally occurring amino acid
CXXXXXXXXXXXXXCXXXXXXXXCXXXXXXXXC

SEQ ID NO: 51 - protein, 35 aa, Artificial sequence
  Synthesized: cysteine motif 11
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(34): Xaa can be any naturally occurring amino acid
CXXXXXXXXXXCXXXXXXCXXXXXCXCXXXXXXXC

SEQ ID NO: 52 - protein, 24 aa, Artificial sequence
  Synthesized: cysteine motif 12
  misc_feature (2)..(11): Xaa can be any naturally occurring amino acid
  misc_feature (13)..(17): Xaa can be any naturally occurring amino acid
  misc_feature (19)..(23): Xaa can be any naturally occurring amino acid
CXXXXXXXXXXCXXXXXCXXXXXC

SEQ ID NO: 53 - protein, 35 aa, Artificial sequence
  Synthesized: cysteine motif 13
  misc_feature (2)..(11): Xaa can be any naturally occurring amino acid
  misc_feature (13)..(17): Xaa can be any naturally occurring amino acid
  misc_feature (19)..(24): Xaa can be any naturally occurring amino acid
  misc_feature (26)..(26): Xaa can be any naturally occurring amino acid
  misc_feature (28)..(34): Xaa can be any naturally occurring amino acid
CXXXXXXXXXXCXXXXXCXXXXXXCXCXXXXXXXC

SEQ ID NO: 54 - protein, 43 aa, Artificial sequence
  Synthesized: cysteine motif 14
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(32): Xaa can be any naturally occurring amino acid
  misc_feature (34)..(42): Xaa can be any naturally occurring amino acid
CXXXXXXXXXXCXXXXXXCXXXXXCXXXXXXXCXXXXXXXXXC

SEQ ID NO: 55 - protein, 35 aa, Artificial sequence
  Synthesized: cysteine motif 15
  misc_feature (2)..(10): Xaa can be any naturally occurring amino acid
  misc_feature (12)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(34): Xaa can be any naturally occurring amino acid
CXXXXXXXXXCXXXXXXXCXXXXXCXCXXXXXXXC

SEQ ID NO: 56 - protein, 37 aa, Artificial sequence
  Synthesized: cysteine motif 16
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(36): Xaa can be any naturally occurring amino acid
CXXXXXXXXXXCXXXXXXCXXXXXCXCXXXXXXXXXC

SEQ ID NO: 57 - protein, 37 aa, Artificial sequence
  Synthesized: cysteine motif 17
  misc_feature (2)..(11): Xaa can be any naturally occurring amino acid
  misc_feature (13)..(13): Xaa can be any naturally occurring amino acid
  misc_feature (15)..(18): Xaa can be any naturally occurring amino acid
  misc_feature (20)..(24): Xaa can be any naturally occurring amino acid
  misc_feature (26)..(36): Xaa can be any naturally occurring amino acid
CXXXXXXXXXXCXCXXXXCXXXXXCXXXXXXXXXXXC

SEQ ID NO: 58 - protein, 45 aa, Artificial sequence
  Synthesized: cysteine motif 18
  misc_feature (2)..(8): Xaa can be any naturally occurring amino acid
  misc_feature (10)..(12): Xaa can be any naturally occurring amino acid
  misc_feature (14)..(19): Xaa can be any naturally occurring amino acid
  misc_feature (21)..(25): Xaa can be any naturally occurring amino acid
  misc_feature (27)..(27): Xaa can be any naturally occurring amino acid
  misc_feature (29)..(33): Xaa can be any naturally occurring amino acid
  misc_feature (35)..(44): Xaa can be any naturally occurring amino acid
CXXXXXXXCXXXCXXXXXXCXXXXXCXCXXXXXCXXXXXXXXXXC

SEQ ID NO: 59 - protein, 34 aa, Artificial sequence
  Synthesized: cysteine motif 19
  misc_feature (2)..(11): Xaa can be any naturally occurring amino acid
  misc_feature (13)..(13): Xaa can be any naturally occurring amino acid
  misc_feature (15)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(33): Xaa can be any naturally occurring amino acid
CXXXXXXXXXXCXCXXXXCXXXXXCXCXXCXXXC

SEQ ID NO: 60 - protein, 26 aa, Artificial sequence
  Synthesized: cysteine motif 20
  misc_feature (2)..(17): Xaa can be any naturally occurring amino acid
  misc_feature (19)..(23): Xaa can be any naturally occurring amino acid
  misc_feature (25)..(25): Xaa can be any naturally occurring amino acid
CXXXXXXXXXXXXXXXXCXXXXXCXC

SEQ ID NO: 61 - protein, 26 aa, Artificial sequence
  Synthesized: cysteine motif 21
  misc_feature (2)..(7): Xaa can be any naturally occurring amino acid
  misc_feature (9)..(12): Xaa can be any naturally occurring amino acid
  misc_feature (14)..(14): Xaa can be any naturally occurring amino acid
  misc_feature (16)..(19): Xaa can be any naturally occurring amino acid
  misc_feature (21)..(25): Xaa can be any naturally occurring amino acid
CXXXXXXCXXXXCXCXXXXCXXXXXC

SEQ ID NO: 62 - protein, 35 aa, Artificial sequence
  Synthesized: cysteine motif 22
  misc_feature (2)..(12): Xaa can be any naturally occurring amino acid
  misc_feature (14)..(17): Xaa can be any naturally occurring amino acid
  misc_feature (19)..(23): Xaa can be any naturally occurring amino acid
  misc_feature (25)..(30): Xaa can be any naturally occurring amino acid
  misc_feature (32)..(34): Xaa can be any naturally occurring amino acid
CXXXXXXXXXXXCXXXXCXXXXXCXXXXXXCXXXC

SEQ ID NO: 63 - protein, 26 aa, Artificial sequence
  Synthesized: cysteine motif 23
  misc_feature (2)..(9): Xaa can be any naturally occurring amino acid
  misc_feature (11)..(12): Xaa can be any naturally occurring amino acid
  misc_feature (14)..(19): Xaa can be any naturally occurring amino acid
  misc_feature (21)..(25): Xaa can be any naturally occurring amino acid
CXXXXXXXXCXXCXXXXXXCXXXXXC

SEQ ID NO: 64 - protein, 37 aa, Artificial sequence
  Synthesized: cysteine motif 24
  misc_feature (2)..(11): Xaa can be any naturally occurring amino acid
  misc_feature (13)..(17): Xaa can be any naturally occurring amino acid
  misc_feature (19)..(23): Xaa can be any naturally occurring amino acid
  misc_feature (25)..(25): Xaa can be any naturally occurring amino acid
  misc_feature (27)..(36): Xaa can be any naturally occurring amino acid
CXXXXXXXXXXCXXXXXCXXXXXCXCXXXXXXXXXXC

SEQ ID NO: 65 - protein, 28 aa, Artificial sequence
  Synthesized: cysteine motif 25
  misc_feature (2)..(11): Xaa can be any naturally occurring amino acid
  misc_feature (13)..(13): Xaa can be any naturally occurring amino acid
  misc_feature (15)..(20): Xaa can be any naturally occurring amino acid
  misc_feature (22)..(25): Xaa can be any naturally occurring amino acid
  misc_feature (27)..(27): Xaa can be any naturally occurring amino acid
CXXXXXXXXXXCXCXXXXXXCXXXXCXC

SEQ ID NO: 66 - protein, 29 aa, Artificial sequence
  Synthesized: cysteine motif 26
  misc_feature (2)..(11): Xaa can be any naturally occurring amino acid
  misc_feature (13)..(17): Xaa can be any naturally occurring amino acid
  misc_feature (19)..(23): Xaa can be any naturally occurring amino acid
  misc_feature (25)..(25): Xaa can be any naturally occurring amino acid
  misc_feature (27)..(28): Xaa can be any naturally occurring amino acid
CXXXXXXXXXXCXXXXXCXXXXXCXCXXC

SEQ ID NO: 67 - protein, 27 aa, Artificial sequence
  Synthesized: cysteine motif 27
  misc_feature (2)..(15): Xaa can be any naturally occurring amino acid
  misc_feature (17)..(18): Xaa can be any naturally occurring amino acid
  misc_feature (20)..(22): Xaa can be any naturally occurring amino acid
  misc_feature (24)..(24): Xaa can be any naturally occurring amino acid
  misc_feature (26)..(26): Xaa can be any naturally occurring amino acid
CXXXXXXXXXXXXXXCXXCXXXCXCXC

SEQ ID NO: 68 - protein, 25 aa, Artificial sequence
  Synthesized: cysteine motif 28
  misc_feature (2)..(16): Xaa can be any naturally occurring amino acid
  misc_feature (18)..(22): Xaa can be any naturally occurring amino acid
  misc_feature (24)..(24): Xaa can be any naturally occurring amino acid
CXXXXXXXXXXXXXXXCXXXXXCXC

SEQ ID NO: 69 - protein, 38 aa, Artificial sequence
  Synthesized: cysteine motif 29
  misc_feature (2)..(5): Xaa can be any naturally occurring amino acid
  misc_feature (7)..(12): Xaa can be any naturally occurring amino acid
  misc_feature (14)..(22): Xaa can be any naturally occurring amino acid
  misc_feature (24)..(25): Xaa can be any naturally occurring amino acid
  misc_feature (27)..(37): Xaa can be any naturally occurring amino acid
CXXXXCXXXXXXCXXXXXXXXXCXXCXXXXXXXXXXXC

SEQ ID NO: 70 - protein, 38 aa, Artificial sequence
  Synthesized: cysteine motif 30
  misc_feature (2)..(7): Xaa can be any naturally occurring amino acid
  misc_feature (9)..(12): Xaa can be any naturally occurring amino acid
  misc_feature (14)..(18): Xaa can be any naturally occurring amino acid
  misc_feature (20)..(24): Xaa can be any naturally occurring amino acid
  misc_feature (26)..(37): Xaa can be any naturally occurring amino acid
CXXXXXXCXXXXCXXXXXCXXXXXCXXXXXXXXXXXXC

SEQ ID NO: 71 - protein, 38 aa, Artificial sequence
  Synthesized: cysteine motif 31
  misc_feature (2)..(8): Xaa can be any naturally occurring amino acid
  misc_feature (10)..(12): Xaa can be any naturally occurring amino acid
  misc_feature (14)..(14): Xaa can be any naturally occurring amino acid
  misc_feature (16)..(16): Xaa can be any naturally occurring amino acid
  misc_feature (18)..(21): Xaa can be any naturally occurring amino acid
  misc_feature (23)..(27): Xaa can be any naturally occurring amino acid
  misc_feature (29)..(37): Xaa can be any naturally occurring amino acid
CXXXXXXXCXXXCXCXCXXXXCXXXXXCXXXXXXXXXC

SEQ ID NO: 72 - protein, 25 aa, Artificial sequence
  Synthesized: cysteine motif 32
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
CXXXXXXXXXXCXXXXXXCXXXXXC

SEQ ID NO: 73 - protein, 35 aa, Artificial sequence
  Synthesized: cysteine motif 33
  misc_feature (2)..(8): Xaa can be any naturally occurring amino acid
  misc_feature (10)..(12): Xaa can be any naturally occurring amino acid
  misc_feature (14)..(18): Xaa can be any naturally occurring amino acid
  misc_feature (20)..(24): Xaa can be any naturally occurring amino acid
  misc_feature (26)..(34): Xaa can be any naturally occurring amino acid
CXXXXXXXCXXXCXXXXXCXXXXXCXXXXXXXXXC

SEQ ID NO: 74 - protein, 20 aa, Artificial sequence
  Synthesized: cysteine motif 34
  misc_feature (2)..(8): Xaa can be any naturally occurring amino acid
  misc_feature (10)..(14): Xaa can be any naturally occurring amino acid
  misc_feature (16)..(16): Xaa can be any naturally occurring amino acid
  misc_feature (18)..(19): Xaa can be any naturally occurring amino acid
CXXXXXXXCXXXXXCXCXXC

SEQ ID NO: 75 - protein, 21 aa, Artificial sequence
  Synthesized: cysteine motif 35
  misc_feature (2)..(11): Xaa can be any naturally occurring amino acid
  misc_feature (13)..(13): Xaa can be any naturally occurring amino acid
  misc_feature (15)..(20): Xaa can be any naturally occurring amino acid
CXXXXXXXXXXCXCXXXXXXC

SEQ ID NO: 76 - protein, 43 aa, Artificial sequence
  Synthesized: cysteine motif 36
  misc_feature (2)..(11): Xaa can be any naturally occurring amino acid
  misc_feature (13)..(15): Xaa can be any naturally occurring amino acid
  misc_feature (17)..(19): Xaa can be any naturally occurring amino acid
  misc_feature (21)..(25): Xaa can be any naturally occurring amino acid
  misc_feature (27)..(33): Xaa can be any naturally occurring amino acid
  misc_feature (35)..(35): Xaa can be any naturally occurring amino acid
  misc_feature (37)..(42): Xaa can be any naturally occurring amino acid
CXXXXXXXXXXCXXXCXXXCXXXXXCXXXXXXXCXCXXXXXXC

SEQ ID NO: 77 - protein, 39 aa, Artificial sequence
  Synthesized: cysteine motif 37
  misc_feature (2)..(11): Xaa can be any naturally occurring amino acid
  misc_feature (13)..(16): Xaa can be any naturally occurring amino acid
  misc_feature (18)..(22): Xaa can be any naturally occurring amino acid
  misc_feature (24)..(35): Xaa can be any naturally occurring amino acid
  misc_feature (37)..(38): Xaa can be any naturally occurring amino acid
CXXXXXXXXXXCXXXXCXXXXXCXXXXXXXXXXXXCXXC

SEQ ID NO: 78 - protein, 43 aa, Artificial sequence
  Synthesized: cysteine motif 38
  misc_feature (2)..(13): Xaa can be any naturally occurring amino acid
  misc_feature (15)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(28): Xaa can be any naturally occurring amino acid
  misc_feature (30)..(38): Xaa can be any naturally occurring amino acid
  misc_feature (40)..(42): Xaa can be any naturally occurring amino acid
CXXXXXXXXXXXXCXXXXCXXXXXCXCXCXXXXXXXXXCXXXC

SEQ ID NO: 79 - protein, 41 aa, Artificial sequence
  Synthesized: cysteine motif 39
  misc_feature (2)..(13): Xaa can be any naturally occurring amino acid
  misc_feature (15)..(18): Xaa can be any naturally occurring amino acid
  misc_feature (20)..(24): Xaa can be any naturally occurring amino acid
  misc_feature (26)..(37): Xaa can be any naturally occurring amino acid
  misc_feature (39)..(40): Xaa can be any naturally occurring amino acid
CXXXXXXXXXXXXCXXXXCXXXXXCXXXXXXXXXXXXCXXC

SEQ ID NO: 80 - protein, 39 aa, Artificial sequence
  Synthesized: cysteine motif 40
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(38): Xaa can be any naturally occurring amino acid
CXXXXXXXXXXCXXXXXXCXXXXXCXCXXXXXXXXXXXC

SEQ ID NO: 81 - protein, 43 aa, Artificial sequence
  Synthesized: cysteine motif 41
  misc_feature (2)..(17): Xaa can be any naturally occurring amino acid
  misc_feature (19)..(23): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(42): Xaa can be any naturally occurring amino acid
CXXXXXXXXXXXXXXXXCXXXXXCXCXCXXXXXXXXXXXXXXC

SEQ ID NO: 82 - protein, 36 aa, Artificial sequence
  Synthesized: cysteine motif 42
  misc_feature (2)..(11): Xaa can be any naturally occurring amino acid
  misc_feature (13)..(17): Xaa can be any naturally occurring amino acid
  misc_feature (19)..(19): Xaa can be any naturally occurring amino acid
  misc_feature (21)..(28): Xaa can be any naturally occurring amino acid
  misc_feature (30)..(35): Xaa can be any naturally occurring amino acid
CXXXXXXXXXXCXXXXXCXCXXXXXXXXCXXXXXXC

SEQ ID NO: 83 - protein, 37 aa, Artificial sequence
  Synthesized: cysteine motif 43
  misc_feature (2)..(13): Xaa can be any naturally occurring amino acid
  misc_feature (15)..(18): Xaa can be any naturally occurring amino acid
  misc_feature (20)..(24): Xaa can be any naturally occurring amino acid
  misc_feature (26)..(33): Xaa can be any naturally occurring amino acid
  misc_feature (35)..(36): Xaa can be any naturally occurring amino acid
CXXXXXXXXXXXXCXXXXCXXXXXCXXXXXXXXCXXC

SEQ ID NO: 84 - protein, 37 aa, Artificial sequence
  Synthesized: cysteine motif 44
  misc_feature (2)..(13): Xaa can be any naturally occurring amino acid
  misc_feature (15)..(19): Xaa can be any naturally occurring amino acid
  misc_feature (21)..(25): Xaa can be any naturally occurring amino acid
  misc_feature (27)..(27): Xaa can be any naturally occurring amino acid
  misc_feature (29)..(36): Xaa can be any naturally occurring amino acid
CXXXXXXXXXXXXCXXXXXCXXXXXCXCXXXXXXXXC

SEQ ID NO: 85 - protein, 44 aa, Artificial sequence
  Synthesized: cysteine motif 45
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(31): Xaa can be any naturally occurring amino acid
  misc_feature (33)..(33): Xaa can be any naturally occurring amino acid
  misc_feature (35)..(43): Xaa can be any naturally occurring amino acid
CXXXXXXXXXXCXXXXXXCXXXXXCXCXXXXCXCXXXXXXXXXC

SEQ ID NO: 86 - protein, 36 aa, Artificial sequence
  Synthesized: cysteine motif 46
  misc_feature (2)..(12): Xaa can be any naturally occurring amino acid
  misc_feature (14)..(17): Xaa can be any naturally occurring amino acid
  misc_feature (19)..(23): Xaa can be any naturally occurring amino acid
  misc_feature (25)..(32): Xaa can be any naturally occurring amino acid
  misc_feature (34)..(35): Xaa can be any naturally occurring amino acid
CXXXXXXXXXXXCXXXXCXXXXXCXXXXXXXXCXXC

SEQ ID NO: 87 - protein, 37 aa, Artificial sequence
  Synthesized: cysteine motif 47
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(33): Xaa can be any naturally occurring amino acid
  misc_feature (35)..(36): Xaa can be any naturally occurring amino acid
CXXXXXXXXXXCXXXXXXCXXXXXCXXXXXXXXCXXC

SEQ ID NO: 88 - protein, 36 aa, Artificial sequence
  Synthesized: cysteine motif 48
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(35): Xaa can be any naturally occurring amino acid
CXXXXXXXXXXCXXXXXXCXXXXXCXCXXXXXXXXC

SEQ ID NO: 89 - protein, 43 aa, Artificial sequence
  Synthesized: cysteine motif 49
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(30): Xaa can be any naturally occurring amino acid
  misc_feature (32)..(39): Xaa can be any naturally occurring amino acid
  misc_feature (41)..(42): Xaa can be any naturally occurring amino acid
CXXXXXXXXXXCXXXXXXCXXXXXCXCXXXCXXXXXXXXCXXC

SEQ ID NO: 90 - protein, 38 aa, Artificial sequence
  Synthesized: cysteine motif 50
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(28): Xaa can be any naturally occurring amino acid
  misc_feature (30)..(37): Xaa can be any naturally occurring amino acid
CXXXXXXXXXXCXXXXXXCXXXXXCXXXCXXXXXXXXC

SEQ ID NO: 91 - protein, 43 aa, Artificial sequence
  Synthesized: cysteine motif 51
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(36): Xaa can be any naturally occurring amino acid
  misc_feature (38)..(42): Xaa can be any naturally occurring amino acid
CXXXXXXXXXXCXXXXXXCXXXXXCXCXXCXXXXXXCXXXXXC

SEQ ID NO: 92 - protein, 34 aa, Artificial sequence
  Synthesized: cysteine motif 52
  misc_feature (2)..(8): Xaa can be any naturally occurring amino acid
  misc_feature (10)..(15): Xaa can be any naturally occurring amino acid
  misc_feature (17)..(19): Xaa can be any naturally occurring amino acid
  misc_feature (21)..(23): Xaa can be any naturally occurring amino acid
  misc_feature (25)..(33): Xaa can be any naturally occurring amino acid
CXXXXXXXCXXXXXXCXXXCXXXCXXXXXXXXXC

SEQ ID NO: 93 - protein, 39 aa, Artificial sequence
  Synthesized: cysteine motif 53
  misc_feature (2)..(10): Xaa can be any naturally occurring amino acid
  misc_feature (12)..(19): Xaa can be any naturally occurring amino acid
  misc_feature (21)..(25): Xaa can be any naturally occurring amino acid
  misc_feature (27)..(32): Xaa can be any naturally occurring amino acid
  misc_feature (34)..(38): Xaa can be any naturally occurring amino acid
CXXXXXXXXXCXXXXXXXXCXXXXXCXXXXXXCXXXXXC

SEQ ID NO: 94 - protein, 46 aa, Artificial sequence
  Synthesized: cysteine motif 54
  misc_feature (2)..(11): Xaa can be any naturally occurring amino acid
  misc_feature (13)..(14): Xaa can be any naturally occurring amino acid
  misc_feature (16)..(17): Xaa can be any naturally occurring amino acid
  misc_feature (19)..(25): Xaa can be any naturally occurring amino acid
  misc_feature (27)..(27): Xaa can be any naturally occurring amino acid
  misc_feature (29)..(39): Xaa can be any naturally occurring amino acid
  misc_feature (41)..(45): Xaa can be any naturally occurring amino acid
CXXXXXXXXXXCXXCXXCXXXXXXXCXCXXXXXXXXXXXCXXXXXC

SEQ ID NO: 95 - protein, 44 aa, Artificial sequence
  Synthesized: cysteine motif 55
  misc_feature (2)..(11): Xaa can be any naturally occurring amino acid
  misc_feature (13)..(18): Xaa can be any naturally occurring amino acid
  misc_feature (20)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(38): Xaa can be any naturally occurring amino acid
  misc_feature (40)..(43): Xaa can be any naturally occurring amino acid
CXXXXXXXXXXCXXXXXXCXXXXXCXCXXCXXXXXXXXCXXXXC

SEQ ID NO: 96 - protein, 42 aa, Artificial sequence
  Synthesized: cysteine motif 56
  misc_feature (3)..(5): Xaa can be any naturally occurring amino acid
  misc_feature (7)..(7): Xaa can be any naturally occurring amino acid
  misc_feature (9)..(11): Xaa can be any naturally occurring amino acid
  misc_feature (13)..(14): Xaa can be any naturally occurring amino acid
  misc_feature (17)..(17): Xaa can be any naturally occurring amino acid
  misc_feature (19)..(23): Xaa can be any naturally occurring amino acid
  misc_feature (25)..(33): Xaa can be any naturally occurring amino acid
  misc_feature (35)..(39): Xaa can be any naturally occurring amino acid
  misc_feature (41)..(41): Xaa can be any naturally occurring amino acid
CCXXXCXCXXXCXXCCXCXXXXXCXXXXXXXXXCXXXXXCXC

SEQ ID NO: 97 - protein, 39 aa, Artificial sequence
  Synthesized: cysteine motif 57
  misc_feature (2)..(7): Xaa can be any naturally occurring amino acid
  misc_feature (9)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(24): Xaa can be any naturally occurring amino acid
  misc_feature (26)..(29): Xaa can be any naturally occurring amino acid
  misc_feature (31)..(36): Xaa can be any naturally occurring amino acid
  misc_feature (38)..(38): Xaa can be any naturally occurring amino acid
CXXXXXXCXXCXXXXXCXXXXCCXCXXXXCXXXXXXCXC

SEQ ID NO: 98 - protein, 38 aa, Artificial sequence
  Synthesized: cysteine motif 58
  misc_feature (2)..(8): Xaa can be any naturally occurring amino acid
  misc_feature (10)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (25)..(28): Xaa can be any naturally occurring amino acid
  misc_feature (30)..(35): Xaa can be any naturally occurring amino acid
  misc_feature (37)..(37): Xaa can be any naturally occurring amino acid
CXXXXXXXCXCXXXXXCXXXXCCCXXXXCXXXXXXCXC

SEQ ID NO: 99 - protein, 36 aa, Artificial sequence
  Synthesized: cysteine motif 59
  misc_feature (2)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(19): Xaa can be any naturally occurring amino acid
  misc_feature (21)..(21): Xaa can be any naturally occurring amino acid
  misc_feature (25)..(30): Xaa can be any naturally occurring amino acid
  misc_feature (32)..(35): Xaa can be any naturally occurring amino acid
CXXXXXXXXXCXXXCXCXXCXCCCXXXXXXCXXXXC

SEQ ID NO: 100 - protein, 39 aa, Artificial sequence
  Synthesized: cysteine motif 60
  misc_feature (2)..(6): Xaa can be any naturally occurring amino acid
  misc_feature (8)..(10): Xaa can be any naturally occurring amino acid
  misc_feature (12)..(12): Xaa can be any naturally occurring amino acid
  misc_feature (14)..(17): Xaa can be any naturally occurring amino acid
  misc_feature (19)..(22): Xaa can be any naturally occurring amino acid
  misc_feature (25)..(34): Xaa can be any naturally occurring amino acid
  misc_feature (36)..(37): Xaa can be any naturally occurring amino acid
CXXXXXCXXXCXCXXXXCXXXXCCXXXXXXXXXXCXXCC

SEQ ID NO: 101 - protein, 38 aa, Artificial sequence
  Synthesized: cysteine motif 61
  misc_feature (2)..(6): Xaa can be any naturally occurring amino acid
  misc_feature (8)..(8): Xaa can be any naturally occurring amino acid
  misc_feature (10)..(10): Xaa can be any naturally occurring amino acid
  misc_feature (12)..(12): Xaa can be any naturally occurring amino acid
  misc_feature (14)..(16): Xaa can be any naturally occurring amino acid
  misc_feature (19)..(21): Xaa can be any naturally occurring amino acid
  misc_feature (23)..(26): Xaa can be any naturally occurring amino acid
  misc_feature (28)..(37): Xaa can be any naturally occurring amino acid
CXXXXXCXCXCXCXXXCCXXXCXXXXCXXXXXXXXXXC

SEQ ID NO: 102 - protein, 37 aa, Artificial sequence
  Synthesized: cysteine motif 62
  misc_feature (2)..(10): Xaa can be any naturally occurring amino acid
  misc_feature (14)..(16): Xaa can be any naturally occurring amino acid
  misc_feature (18)..(21): Xaa can be any naturally occurring amino acid
  misc_feature (25)..(29): Xaa can be any naturally occurring amino acid
  misc_feature (31)..(36): Xaa can be any naturally occurring amino acid
CXXXXXXXXXCCCXXXCXXXXCCCXXXXXCXXXXXXC

SEQ ID NO: 103 - protein, 36 aa, Artificial sequence
  Synthesized: cysteine motif 63
  misc_feature (3)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (23)..(25): Xaa can be any naturally occurring amino acid
  misc_feature (27)..(30): Xaa can be any naturally occurring amino acid
  misc_feature (33)..(33): Xaa can be any naturally occurring amino acid
  misc_feature (35)..(35): Xaa can be any naturally occurring amino acid
CCXXXXXXXXCXXXXXCXXXXCXXXCXXXXCCXCXC

SEQ ID NO: 104 - protein, 41 aa, Artificial sequence
  Synthesized: cysteine motif 64
  misc_feature (3)..(8): Xaa can be any naturally occurring amino acid
  misc_feature (11)..(15): Xaa can be any naturally occurring amino acid
  misc_feature (19)..(22): Xaa can be any naturally occurring amino acid
  misc_feature (24)..(27): Xaa can be any naturally occurring amino acid
  misc_feature (29)..(40): Xaa can be any naturally occurring amino acid
CCXXXXXXCCXXXXXCCCXXXXCXXXXCXXXXXXXXXXXXC

SEQ ID NO: 105 - protein, 36 aa, Artificial sequence
  Synthesized: cysteine motif 65
  misc_feature (2)..(7): Xaa can be any naturally occurring amino acid
  misc_feature (9)..(10): Xaa can be any naturally occurring amino acid
  misc_feature (12)..(14): Xaa can be any naturally occurring amino acid
  misc_feature (18)..(21): Xaa can be any naturally occurring amino acid
  misc_feature (23)..(27): Xaa can be any naturally occurring amino acid
  misc_feature (29)..(31): Xaa can be any naturally occurring amino acid
  misc_feature (33)..(35): Xaa can be any naturally occurring amino acid
CXXXXXXCXXCXXXCCCXXXXCXXXXXCXXXCXXXC

SEQ ID NO: 106 - protein, 39 aa, Artificial sequence
  Synthesized: cysteine motif 66
  misc_feature (2)..(4): Xaa can be any naturally occurring amino acid
  misc_feature (6)..(10): Xaa can be any naturally occurring amino acid
  misc_feature (12)..(17): Xaa can be any naturally occurring amino acid
  misc_feature (19)..(22): Xaa can be any naturally occurring amino acid
  misc_feature (25)..(25): Xaa can be any naturally occurring amino acid
  misc_feature (27)..(31): Xaa can be any naturally occurring amino acid
  misc_feature (33)..(36): Xaa can be any naturally occurring amino acid
  misc_feature (38)..(38): Xaa can be any naturally occurring amino acid
CXXXCXXXXXCXXXXXXCXXXXCCXCXXXXXCXXXXCXC

SEQ ID NO: 107 - protein, 41 aa, Artificial sequence
  Synthesized: cysteine motif 67
  misc_feature (2)..(5): Xaa can be any naturally occurring amino acid
  misc_feature (7)..(10): Xaa can be any naturally occurring amino acid
  misc_feature (13)..(16): Xaa can be any naturally occurring amino acid
  misc_feature (18)..(21): Xaa can be any naturally occurring amino acid
  misc_feature (23)..(23): Xaa can be any naturally occurring amino acid
  misc_feature (25)..(35): Xaa can be any naturally occurring amino acid
  misc_feature (37)..(38): Xaa can be any naturally occurring amino acid
  misc_feature (40)..(40): Xaa can be any naturally occurring amino acid
CXXXXCXXXXCCXXXXCXXXXCXCXXXXXXXXXXXCXXCXC

SEQ ID NO: 108 - protein, 36 aa, Artificial sequence
  Synthesized: cysteine motif 68
  misc_feature (2)..(6): Xaa can be any naturally occurring amino acid
  misc_feature (8)..(9): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(26): Xaa can be any naturally occurring amino acid
  misc_feature (29)..(35): Xaa can be any naturally occurring amino acid
CXXXXXCXXCCXXXXXCXXXXCCXXXCCXXXXXXXC

SEQ ID NO: 109 - protein, 38 aa, Artificial sequence
  Synthesized: cysteine motif 69
  misc_feature (2)..(6): Xaa can be any naturally occurring amino acid
  misc_feature (8)..(12): Xaa can be any naturally occurring amino acid
  misc_feature (14)..(16): Xaa can be any naturally occurring amino acid
  misc_feature (18)..(19): Xaa can be any naturally occurring amino acid
  misc_feature (21)..(21): Xaa can be any naturally occurring amino acid
  misc_feature (24)..(27): Xaa can be any naturally occurring amino acid
  misc_feature (29)..(35): Xaa can be any naturally occurring amino acid
  misc_feature (37)..(37): Xaa can be any naturally occurring amino acid
CXXXXXCXXXXXCXXXCXXCXCCXXXXCXXXXXXXCXC

SEQ ID NO: 110 - protein, 37 aa, Artificial sequence
  Synthesized: cysteine motif 70
  misc_feature (2)..(4): Xaa can be any naturally occurring amino acid
  misc_feature (6)..(12): Xaa can be any naturally occurring amino acid
  misc_feature (14)..(16): Xaa can be any naturally occurring amino acid
  misc_feature (18)..(21): Xaa can be any naturally occurring amino acid
  misc_feature (24)..(24): Xaa can be any naturally occurring amino acid
  misc_feature (26)..(27): Xaa can be any naturally occurring amino acid
  misc_feature (29)..(33): Xaa can be any naturally occurring amino acid
  misc_feature (35)..(36): Xaa can be any naturally occurring amino acid
CXXXCXXXXXXXCXXXCXXXXCCXCXXCXXXXXCXXC

SEQ ID NO: 111 - protein, 38 aa, Artificial sequence
  Synthesized: cysteine motif 71
  misc_feature (2)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(21): Xaa can be any naturally occurring amino acid
  misc_feature (24)..(28): Xaa can be any naturally occurring amino acid
  misc_feature (32)..(37): Xaa can be any naturally occurring amino acid
CXXXXXXXXXCXXXCXCXXXXCCXXXXXCCCXXXXXXC

SEQ ID NO: 112 - protein, 38 aa, Artificial sequence
  Synthesized: cysteine motif 72
  misc_feature (2)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(19): Xaa can be any naturally occurring amino acid
  misc_feature (21)..(21): Xaa can be any naturally occurring amino acid
  misc_feature (24)..(29): Xaa can be any naturally occurring amino acid
  misc_feature (31)..(33): Xaa can be any naturally occurring amino acid
  misc_feature (35)..(37): Xaa can be any naturally occurring amino acid
CXXXXXXXXXCXXXCXCXXCXCCXXXXXXCXXXCXXXC

SEQ ID NO: 113 - protein, 33 aa, Artificial sequence
  Synthesized: cysteine motif 73
  misc_feature (2)..(9): Xaa can be any naturally occurring amino acid
  misc_feature (12)..(12): Xaa can be any naturally occurring amino acid
  misc_feature (14)..(16): Xaa can be any naturally occurring amino acid
  misc_feature (19)..(21): Xaa can be any naturally occurring amino acid
  misc_feature (23)..(23): Xaa can be any naturally occurring amino acid
  misc_feature (25)..(27): Xaa can be any naturally occurring amino acid
  misc_feature (29)..(32): Xaa can be any naturally occurring amino acid
CXXXXXXXXCCXCXXXCCXXXCXCXXXCXXXXC

SEQ ID NO: 114 - protein, 34 aa, Artificial sequence
  Synthesized: cysteine motif 74
  misc_feature (2)..(10): Xaa can be any naturally occurring amino acid
  misc_feature (13)..(16): Xaa can be any naturally occurring amino acid
  misc_feature (18)..(19): Xaa can be any naturally occurring amino acid
  misc_feature (21)..(21): Xaa can be any naturally occurring amino acid
  misc_feature (24)..(24): Xaa can be any naturally occurring amino acid
  misc_feature (26)..(29): Xaa can be any naturally occurring amino acid
  misc_feature (31)..(33): Xaa can be any naturally occurring amino acid
CXXXXXXXXXCCXXXXCXXCXCCXCXXXXCXXXC

SEQ ID NO: 115 - protein, 37 aa, Artificial sequence
  Synthesized: cysteine motif 75
  misc_feature (2)..(11): Xaa can be any naturally occurring amino acid
  misc_feature (13)..(13): Xaa can be any naturally occurring amino acid
  misc_feature (15)..(17): Xaa can be any naturally occurring amino acid
  misc_feature (19)..(20): Xaa can be any naturally occurring amino acid
  misc_feature (22)..(22): Xaa can be any naturally occurring amino acid
  misc_feature (25)..(28): Xaa can be any naturally occurring amino acid
  misc_feature (30)..(34): Xaa can be any naturally occurring amino acid
  misc_feature (36)..(36): Xaa can be any naturally occurring amino acid
CXXXXXXXXXXCXCXXXCXXCXCCXXXXCXXXXXCXC

SEQ ID NO: 116 - protein, 36 aa, Artificial sequence
  Synthesized: cysteine motif 76
  misc_feature (2)..(10): Xaa can be any naturally occurring amino acid
  misc_feature (12)..(12): Xaa can be any naturally occurring amino acid
  misc_feature (14)..(16): Xaa can be any naturally occurring amino acid
  misc_feature (18)..(19): Xaa can be any naturally occurring amino acid
  misc_feature (21)..(21): Xaa can be any naturally occurring amino acid
  misc_feature (24)..(27): Xaa can be any naturally occurring amino acid
  misc_feature (29)..(33): Xaa can be any naturally occurring amino acid
  misc_feature (35)..(35): Xaa can be any naturally occurring amino acid
CXXXXXXXXXCXCXXXCXXCXCCXXXXCXXXXXCXC

SEQ ID NO: 117 - protein, 34 aa, Artificial sequence
  Synthesized: cysteine motif 77
  misc_feature (2)..(7): Xaa can be any naturally occurring amino acid
  misc_feature (10)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(24): Xaa can be any naturally occurring amino acid
  misc_feature (26)..(30): Xaa can be any naturally occurring amino acid
  misc_feature (32)..(33): Xaa can be any naturally occurring amino acid
CXXXXXXCCXCXXXXXCXXXXCCXCXXXXXCXXC

SEQ ID NO: 118 - protein, 28 aa, Artificial sequence
  Synthesized: cysteine motif 78
  misc_feature (2)..(7): Xaa can be any naturally occurring amino acid
  misc_feature (10)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (19)..(21): Xaa can be any naturally occurring amino acid
  misc_feature (23)..(26): Xaa can be any naturally occurring amino acid
CXXXXXXCCXCXXXCXCCXXXCXXXXCC

SEQ ID NO: 119 - protein, 36 aa, Artificial sequence
  Synthesized: cysteine motif 79
  misc_feature (2)..(7): Xaa can be any naturally occurring amino acid
  misc_feature (10)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(19): Xaa can be any naturally occurring amino acid
  misc_feature (21)..(21): Xaa can be any naturally occurring amino acid
  misc_feature (23)..(26): Xaa can be any naturally occurring amino acid
  misc_feature (28)..(35): Xaa can be any naturally occurring amino acid
CXXXXXXCCXCXXXCXCXXCXCXXXXCXXXXXXXXC

SEQ ID NO: 120 - protein, 29 aa, Artificial sequence
  Synthesized: cysteine motif 80
  misc_feature (2)..(5): Xaa can be any naturally occurring amino acid
  misc_feature (7)..(8): Xaa can be any naturally occurring amino acid
  misc_feature (11)..(13): Xaa can be any naturally occurring amino acid
  misc_feature (15)..(15): Xaa can be any naturally occurring amino acid
  misc_feature (17)..(20): Xaa can be any naturally occurring amino acid
  misc_feature (23)..(24): Xaa can be any naturally occurring amino acid
  misc_feature (26)..(28): Xaa can be any naturally occurring amino acid
CXXXXCXXCCXXXCXCXXXXCCXXCXXXC

SEQ ID NO: 121 - protein, 32 aa, Artificial sequence
  Synthesized: cysteine motif 81
  misc_feature (2)..(4): Xaa can be any naturally occurring amino acid
  misc_feature (6)..(10): Xaa can be any naturally occurring amino acid
  misc_feature (12)..(14): Xaa can be any naturally occurring amino acid
  misc_feature (18)..(21): Xaa can be any naturally occurring amino acid
  misc_feature (23)..(31): Xaa can be any naturally occurring amino acid
CXXXCXXXXXCXXXCCCXXXXCXXXXXXXXXC

SEQ ID NO: 122 - protein, 29 aa, Artificial sequence
  Synthesized: cysteine motif 82
  misc_feature (3)..(11): Xaa can be any naturally occurring amino acid
  misc_feature (13)..(15): Xaa can be any naturally occurring amino acid
  misc_feature (17)..(17): Xaa can be any naturally occurring amino acid
  misc_feature (20)..(22): Xaa can be any naturally occurring amino acid
  misc_feature (24)..(28): Xaa can be any naturally occurring amino acid
CCXXXXXXXXXCXXXCXCCXXXCXXXXXC

SEQ ID NO: 123 - protein, 35 aa, Artificial sequence
  Synthesized: cysteine motif 83
  misc_feature (2)..(10): Xaa can be any naturally occurring amino acid
  misc_feature (12)..(13): Xaa can be any naturally occurring amino acid
  misc_feature (15)..(17): Xaa can be any naturally occurring amino acid
  misc_feature (19)..(22): Xaa can be any naturally occurring amino acid
  misc_feature (25)..(28): Xaa can be any naturally occurring amino acid
  misc_feature (30)..(34): Xaa can be any naturally occurring amino acid
CXXXXXXXXXCXXCXXXCXXXXCCXXXXCXXXXXC

SEQ ID NO: 124 - protein, 39 aa, Artificial sequence
  Synthesized: cysteine motif 84
  misc_feature (2)..(10): Xaa can be any naturally occurring amino acid
  misc_feature (12)..(18): Xaa can be any naturally occurring amino acid
  misc_feature (20)..(23): Xaa can be any naturally occurring amino acid
  misc_feature (26)..(26): Xaa can be any naturally occurring amino acid
  misc_feature (28)..(34): Xaa can be any naturally occurring amino acid
  misc_feature (36)..(38): Xaa can be any naturally occurring amino acid
CXXXXXXXXXCXXXXXXXCXXXXCCXCXXXXXXXCXXXC

SEQ ID NO: 125 - protein, 35 aa, Artificial sequence
  Synthesized: cysteine motif 85
  misc_feature (2)..(10): Xaa can be any naturally occurring amino acid
  misc_feature (12)..(14): Xaa can be any naturally occurring amino acid
  misc_feature (18)..(27): Xaa can be any naturally occurring amino acid
  misc_feature (29)..(30): Xaa can be any naturally occurring amino acid
  misc_feature (32)..(34): Xaa can be any naturally occurring amino acid
CXXXXXXXXXCXXXCCCXXXXXXXXXXCXXCXXXC

SEQ ID NO: 126 - protein, 41 aa, Artificial sequence
  Synthesized: cysteine motif 86
  misc_feature (2)..(4): Xaa can be any naturally occurring amino acid
  misc_feature (6)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(33): Xaa can be any naturally occurring amino acid
  misc_feature (35)..(40): Xaa can be any naturally occurring amino acid
CXXXCXXXXXCXXXXXCXXXXCCXXXXXXXXXXCXXXXXXC

SEQ ID NO: 127 - protein, 36 aa, Artificial sequence
  Synthesized: cysteine motif 87
  misc_feature (2)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(24): Xaa can be any naturally occurring amino acid
  misc_feature (26)..(30): Xaa can be any naturally occurring amino acid
  misc_feature (32)..(35): Xaa can be any naturally occurring amino acid
CXXXXXXXXXCXXXXXCXXXXCCXCXXXXXCXXXXC

SEQ ID NO: 128 - protein, 36 aa, Artificial sequence
  Synthesized: cysteine motif 88
  misc_feature (2)..(8): Xaa can be any naturally occurring amino acid
  misc_feature (10)..(10): Xaa can be any naturally occurring amino acid
  misc_feature (12)..(17): Xaa can be any naturally occurring amino acid
  misc_feature (19)..(22): Xaa can be any naturally occurring amino acid
  misc_feature (26)..(35): Xaa can be any naturally occurring amino acid
CXXXXXXXCXCXXXXXXCXXXXCCCXXXXXXXXXXC

SEQ ID NO: 129 - protein, 32 aa, Artificial sequence
  Synthesized: cysteine motif 89
  misc_feature (2)..(9): Xaa can be any naturally occurring amino acid
  misc_feature (11)..(12): Xaa can be any naturally occurring amino acid
  misc_feature (14)..(17): Xaa can be any naturally occurring amino acid
  misc_feature (20)..(23): Xaa can be any naturally occurring amino acid
  misc_feature (25)..(27): Xaa can be any naturally occurring amino acid
  misc_feature (29)..(31): Xaa can be any naturally occurring amino acid
CXXXXXXXXCXXCXXXXCCXXXXCXXXCXXXC

SEQ ID NO: 130 - protein, 36 aa, Artificial sequence
  Synthesized: cysteine motif 90
  misc_feature (2)..(8): Xaa can be any naturally occurring amino acid
  misc_feature (10)..(14): Xaa can be any naturally occurring amino acid
  misc_feature (16)..(16): Xaa can be any naturally occurring amino acid
  misc_feature (18)..(21): Xaa can be any naturally occurring amino acid
  misc_feature (24)..(30): Xaa can be any naturally occurring amino acid
  misc_feature (32)..(35): Xaa can be any naturally occurring amino acid
CXXXXXXXCXXXXXCXCXXXXCCXXXXXXXCXXXXC

SEQ ID NO: 131 - protein, 36 aa, Artificial sequence
  Synthesized: cysteine motif 91
  misc_feature (2)..(12): Xaa can be any naturally occurring amino acid
  misc_feature (14)..(16): Xaa can be any naturally occurring amino acid
  misc_feature (18)..(21): Xaa can be any naturally occurring amino acid
  misc_feature (25)..(32): Xaa can be any naturally occurring amino acid
  misc_feature (34)..(35): Xaa can be any naturally occurring amino acid
CXXXXXXXXXXXCXXXCXXXXCCCXXXXXXXXCXXC

SEQ ID NO: 132 - protein, 41 aa, Artificial sequence
  Synthesized: cysteine motif 92
  misc_feature (2)..(3): Xaa can be any naturally occurring amino acid
  misc_feature (5)..(7): Xaa can be any naturally occurring amino acid
  misc_feature (9)..(12): Xaa can be any naturally occurring amino acid
  misc_feature (15)..(18): Xaa can be any naturally occurring amino acid
  misc_feature (20)..(24): Xaa can be any naturally occurring amino acid
  misc_feature (26)..(40): Xaa can be any naturally occurring amino acid
CXXCXXXCXXXXCCXXXXCXXXXXCXXXXXXXXXXXXXXXC

SEQ ID NO: 133 - protein, 31 aa, Artificial sequence
  Synthesized: cysteine motif 93
  misc_feature (2)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(30): Xaa can be any naturally occurring amino acid
CXXXXXXXXXCXXXXXCXXXXCCXXXXXXXC

SEQ ID NO: 134 - protein, 33 aa, Artificial sequence
  Synthesized: cysteine motif 94
  misc_feature (2)..(10): Xaa can be any naturally occurring amino acid
  misc_feature (12)..(18): Xaa can be any naturally occurring amino acid
  misc_feature (20)..(22): Xaa can be any naturally occurring amino acid
  misc_feature (24)..(25): Xaa can be any naturally occurring amino acid
  misc_feature (27)..(32): Xaa can be any naturally occurring amino acid
CXXXXXXXXXCXXXXXXXCXXXCXXCXXXXXXC

SEQ ID NO: 135 - protein, 38 aa, Artificial sequence
  Synthesized: cysteine motif 95
  misc_feature (2)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(37): Xaa can be any naturally occurring amino acid
CXXXXXXXXXCXXXXXCXXXXCCXXXXXXXXXXXXXXC

SEQ ID NO: 136 - protein, 32 aa, Artificial sequence
  Synthesized: cysteine motif 96
  misc_feature (2)..(10): Xaa can be any naturally occurring amino acid
  misc_feature (12)..(16): Xaa can be any naturally occurring amino acid
  misc_feature (18)..(21): Xaa can be any naturally occurring amino acid
  misc_feature (24)..(31): Xaa can be any naturally occurring amino acid
CXXXXXXXXXCXXXXXCXXXXCCXXXXXXXXC

SEQ ID NO: 137 - protein, 26 aa, Artificial sequence
  Synthesized: cysteine motif 97
  misc_feature (2)..(10): Xaa can be any naturally occurring amino acid
  misc_feature (12)..(17): Xaa can be any naturally occurring amino acid
  misc_feature (19)..(22): Xaa can be any naturally occurring amino acid
  misc_feature (25)..(25): Xaa can be any naturally occurring amino acid
CXXXXXXXXXCXXXXXXCXXXXCCXC

SEQ ID NO: 138 - protein, 33 aa, Artificial sequence
  Synthesized: cysteine motif 98
  misc_feature (2)..(6): Xaa can be any naturally occurring amino acid
  misc_feature (9)..(15): Xaa can be any naturally occurring amino acid
  misc_feature (17)..(20): Xaa can be any naturally occurring amino acid
  misc_feature (22)..(33): Xaa can be any naturally occurring amino acid
CXXXXXCCXXXXXXXCXXXXCXXXXXXXXXXXX

SEQ ID NO: 139 - protein, 27 aa, Artificial sequence
  Synthesized: cysteine motif 99
  misc_feature (2)..(11): Xaa can be any naturally occurring amino acid
  misc_feature (13)..(15): Xaa can be any naturally occurring amino acid
  misc_feature (17)..(20): Xaa can be any naturally occurring amino acid
  misc_feature (23)..(26): Xaa can be any naturally occurring amino acid
CXXXXXXXXXXCXXXCXXXXCCXXXXC

SEQ ID NO: 140 - protein, 28 aa, Artificial sequence
  Synthesized: cysteine motif 100
  misc_feature (2)..(10): Xaa can be any naturally occurring amino acid
  misc_feature (12)..(15): Xaa can be any naturally occurring amino acid
  misc_feature (18)..(22): Xaa can be any naturally occurring amino acid
  misc_feature (24)..(27): Xaa can be any naturally occurring amino acid
CXXXXXXXXXCXXXXCCXXXXXCXXXXC

SEQ ID NO: 141 - protein, 31 aa, Artificial sequence
  Synthesized: cysteine motif 101
  misc_feature (2)..(11): Xaa can be any naturally occurring amino acid
  misc_feature (13)..(15): Xaa can be any naturally occurring amino acid
  misc_feature (17)..(20): Xaa can be any naturally occurring amino acid
  misc_feature (22)..(28): Xaa can be any naturally occurring amino acid
  misc_feature (30)..(30): Xaa can be any naturally occurring amino acid
CXXXXXXXXXXCXXXCXXXXCXXXXXXXCXC

SEQ ID NO: 142 - protein, 27 aa, Artificial sequence
  Synthesized: cysteine motif 102
  misc_feature (2)..(8): Xaa can be any naturally occurring amino acid
  misc_feature (10)..(16): Xaa can be any naturally occurring amino acid
  misc_feature (18)..(19): Xaa can be any naturally occurring amino acid
  misc_feature (21)..(22): Xaa can be any naturally occurring amino acid
  misc_feature (24)..(26): Xaa can be any naturally occurring amino acid
CXXXXXXXCXXXXXXXCXXCXXCXXXC

SEQ ID NO: 143 - protein, 29 aa, Artificial sequence
  Synthesized: cysteine motif 103
  misc_feature (2)..(10): Xaa can be any naturally occurring amino acid
  misc_feature (12)..(15): Xaa can be any naturally occurring amino acid
  misc_feature (17)..(20): Xaa can be any naturally occurring amino acid
  misc_feature (23)..(28): Xaa can be any naturally occurring amino acid
CXXXXXXXXXCXXXXCXXXXCCXXXXXXC

SEQ ID NO: 144 - protein, 24 aa, Artificial sequence
  Synthesized: cysteine motif 104
  misc_feature (2)..(8): Xaa can be any naturally occurring amino acid
  misc_feature (10)..(10): Xaa can be any naturally occurring amino acid
  misc_feature (12)..(14): Xaa can be any naturally occurring amino acid
  misc_feature (16)..(16): Xaa can be any naturally occurring amino acid
  misc_feature (18)..(23): Xaa can be any naturally occurring amino acid
CXXXXXXXCXCXXXCXCXXXXXXC

SEQ ID NO: 145 - protein, 23 aa, Artificial sequence
  Synthesized: cysteine motif 105
  misc_feature (2)..(8): Xaa can be any naturally occurring amino acid
  misc_feature (10)..(10): Xaa can be any naturally occurring amino acid
  misc_feature (12)..(15): Xaa can be any naturally occurring amino acid
  misc_feature (17)..(17): Xaa can be any naturally occurring amino acid
  misc_feature (19)..(22): Xaa can be any naturally occurring amino acid
CXXXXXXXCXCXXXXCXCXXXXC

SEQ ID NO: 146 - protein, 22 aa, Artificial sequence
  Synthesized: cysteine motif 106
  misc_feature (2)..(10): Xaa can be any naturally occurring amino acid
  misc_feature (12)..(16): Xaa can be any naturally occurring amino acid
  misc_feature (18)..(21): Xaa can be any naturally occurring amino acid
CXXXXXXXXXCXXXXXCXXXXC

SEQ ID NO: 147 - protein, 21 aa, Artificial sequence
  Synthesized: cysteine motif 107
  misc_feature (2)..(4): Xaa can be any naturally occurring amino acid
  misc_feature (6)..(11): Xaa can be any naturally occurring amino acid
  misc_feature (13)..(20): Xaa can be any naturally occurring amino acid
CXXXCXXXXXXCXXXXXXXXC

SEQ ID NO: 148 - protein, 19 aa, Artificial sequence
  Synthesized: cysteine motif 108
  misc_feature (2)..(11): Xaa can be any naturally occurring amino acid
  misc_feature (13)..(13): Xaa can be any naturally occurring amino acid
  misc_feature (15)..(18): Xaa can be any naturally occurring amino acid
CXXXXXXXXXXCXCXXXXC

SEQ ID NO: 149 - protein, 18 aa, Artificial sequence
  Synthesized: cysteine motif 109
  misc_feature (2)..(11): Xaa can be any naturally occurring amino acid
  misc_feature (14)..(17): Xaa can be any naturally occurring amino acid
CXXXXXXXXXXCCXXXXC

SEQ ID NO: 150 - protein, 17 aa, Artificial sequence
  Synthesized: cysteine motif 110
  misc_feature (2)..(16): Xaa can be any naturally occurring amino acid
CXXXXXXXXXXXXXXXC

SEQ ID NO: 151 - protein, 12 aa, Artificial sequence
  Synthesized: cysteine motif 111
  misc_feature (2)..(11): Xaa can be any naturally occurring amino acid
CXXXXXXXXXXC

SEQ ID NO: 152 - protein, 11 aa, Artificial sequence
  Synthesized: cysteine motif 112
  misc_feature (2)..(10): Xaa can be any naturally occurring amino acid
CXXXXXXXXXC

SEQ ID NO: 153 - protein, 5 aa, Artificial sequence
  Synthesized: X1X2X3X4X5 motif 1
TTVHQ

SEQ ID NO: 154 - protein, 5 aa, Artificial sequence
  Synthesized: X1X2X3X4X5 motif 2
TSVHQ

SEQ ID NO: 155 - protein, 5 aa, Artificial sequence
  Synthesized: X1X2X3X4X5 motif 3
SSVTQ

SEQ ID NO: 156 - protein, 5 aa, Artificial sequence
  Synthesized: X1X2X3X4X5 motif 4
STVHQ

SEQ ID NO: 157 - protein, 5 aa, Artificial sequence
  Synthesized: X1X2X3X4X5 motif 5
ATVRQ

SEQ ID NO: 158 - protein, 5 aa, Artificial sequence
  Synthesized: X1X2X3X4X5 motif 6
TTVYQ

SEQ ID NO: 159 - protein, 5 aa, Artificial sequence
  Synthesized: X1X2X3X4X5 motif 7
SPVHQ

SEQ ID NO: 160 - protein, 5 aa, Artificial sequence
  Synthesized: X1X2X3X4X5 motif 8
ATVYQ

SEQ ID NO: 161 - protein, 5 aa, Artificial sequence
  Synthesized: X1X2X3X4X5 motif 9
TAVYQ

SEQ ID NO: 162 - protein, 5 aa, Artificial sequence
  Synthesized: X1X2X3X4X5 motif 10
TNVHQ

SEQ ID NO: 163 - protein, 5 aa, Artificial sequence
  Synthesized: X1X2X3X4X5 motif 11
ATVHQ

SEQ ID NO: 164 - protein, 5 aa, Artificial sequence
  Synthesized: X1X2X3X4X5 motif 12
STVYQ

SEQ ID NO: 165 - protein, 5 aa, Artificial sequence
  Synthesized: X1X2X3X4X5 motif 13
TIVHQ

SEQ ID NO: 166 - protein, 5 aa, Artificial sequence
  Synthesized: X1X2X3X4X5 motif 14
AIVYQ

SEQ ID NO: 167 - protein, 5 aa, Artificial sequence
  Synthesized: X1X2X3X4X5 motif 15
TTVFQ

SEQ ID NO: 168 - protein, 5 aa, Artificial sequence
  Synthesized: X1X2X3X4X5 motif 16
AAVFQ

SEQ ID NO: 169 - protein, 5 aa, Artificial sequence
  Synthesized: X1X2X3X4X5 motif 17
GTVHQ

SEQ ID NO: 170 - protein, 5 aa, Artificial sequence
  Synthesized: X1X2X3X4X5 motif 18
ASVHQ

SEQ ID NO: 171 - protein, 5 aa, Artificial sequence
  Synthesized: X1X2X3X4X5 motif 19
TAVFQ

SEQ ID NO: 172 - protein, 5 aa, Artificial sequence
  Synthesized: X1X2X3X4X5 motif 20
ATVFQ

SEQ ID NO: 173 - protein, 5 aa, Artificial sequence
  Synthesized: X1X2X3X4X5 motif 21
AAAHQ

SEQ ID NO: 174 - protein, 5 aa, Artificial sequence
  Synthesized: X1X2X3X4X5 motif 22
VVVYQ

SEQ ID NO: 175 - protein, 5 aa, Artificial sequence
  Synthesized: X1X2X3X4X5 motif 23
GTVFQ

SEQ ID NO: 176 - protein, 5 aa, Artificial sequence
  Synthesized: X1X2X3X4X5 motif 24
TAVHQ

SEQ ID NO: 177 - protein, 5 aa, Artificial sequence
  Synthesized: X1X2X3X4X5 motif 25
ITVHQ

SEQ ID NO: 178 - protein, 5 aa, Artificial sequence
  Synthesized: X1X2X3X4X5 motif 26
ITAHQ

SEQ ID NO: 179 - protein, 5 aa, Artificial sequence
  Synthesized: X1X2X3X4X5 motif 27
VTVHQ

SEQ ID NO: 180 - protein, 5 aa, Artificial sequence
  Synthesized: X1X2X3X4X5 motif 28
AAVHQ

SEQ ID NO: 181 - protein, 5 aa, Artificial sequence
  Synthesized: X1X2X3X4X5 motif 29
GTVYQ

SEQ ID NO: 182 - protein, 5 aa, Artificial sequence
  Synthesized: X1X2X3X4X5 motif 30
TTVLQ

SEQ ID NO: 183 - protein, 5 aa, Artificial sequence
  Synthesized: X1X2X3X4X5 motif 31
TTTHQ

SEQ ID NO: 184 - protein, 5 aa, Artificial sequence
  Synthesized: X1X2X3X4X5 motif 32
TTDYQ

SEQ ID NO: 185 - protein, 6 aa, Artificial sequence
  Synthesized: CX1X2X3X4X5 motif 1
CTTVHQ

SEQ ID NO: 186 - protein, 6 aa, Artificial sequence
  Synthesized: CX1X2X3X4X5 motif 2
CTSVHQ

SEQ ID NO: 187 - protein, 6 aa, Artificial sequence
  Synthesized: CX1X2X3X4X5 motif 3
CSSVTQ

SEQ ID NO: 188 - protein, 6 aa, Artificial sequence
  Synthesized: CX1X2X3X4X5 motif 4
CSTVHQ

SEQ ID NO: 189 - protein, 6 aa, Artificial sequence
  Synthesized: CX1X2X3X4X5 motif 5
CATVRQ

SEQ ID NO: 190 - protein, 6 aa, Artificial sequence
  Synthesized: CX1X2X3X4X5 motif 6
CTTVYQ

SEQ ID NO: 191 - protein, 6 aa, Artificial sequence
  Synthesized: CX1X2X3X4X5 motif 7
CSPVHQ

SEQ ID NO: 192 - protein, 6 aa, Artificial sequence
  Synthesized: CX1X2X3X4X5 motif 8
CATVYQ

SEQ ID NO: 193 - protein, 6 aa, Artificial sequence
  Synthesized: CX1X2X3X4X5 motif 9
CTAVYQ

SEQ ID NO: 194 - protein, 6 aa, Artificial sequence
  Synthesized: CX1X2X3X4X5 motif 10
CTNVHQ

SEQ ID NO: 195 - protein, 6 aa, Artificial sequence
  Synthesized: CX1X2X3X4X5 motif 11
CATVHQ

SEQ ID NO: 196 - protein, 6 aa, Artificial sequence
  Synthesized: CX1X2X3X4X5 motif 12
CSTVYQ

SEQ ID NO: 197 - protein, 6 aa, Artificial sequence
  Synthesized: CX1X2X3X4X5 motif 13
CTIVHQ

SEQ ID NO: 198 - protein, 6 aa, Artificial sequence
  Synthesized: CX1X2X3X4X5 motif 14
CAIVYQ

SEQ ID NO: 199 - protein, 6 aa, Artificial sequence
  Synthesized: CX1X2X3X4X5 motif 15
CTTVFQ

SEQ ID NO: 200 - protein, 6 aa, Artificial sequence
  Synthesized: CX1X2X3X4X5 motif 16
CAAVFQ

SEQ ID NO: 201 - protein, 6 aa, Artificial sequence
  Synthesized: CX1X2X3X4X5 motif 17
CGTVHQ

SEQ ID NO: 202 - protein, 6 aa, Artificial sequence
  Synthesized: CX1X2X3X4X5 motif 18
CASVHQ

SEQ ID NO: 203 - protein, 6 aa, Artificial sequence
  Synthesized: CX1X2X3X4X5 motif 19
CTAVFQ

SEQ ID NO: 204 - protein, 6 aa, Artificial sequence
  Synthesized: CX1X2X3X4X5 motif 20
CATVFQ

SEQ ID NO: 205 - protein, 6 aa, Artificial sequence
  Synthesized: CX1X2X3X4X5 motif 21
CAAAHQ

SEQ ID NO: 206 - protein, 6 aa, Artificial sequence
  Synthesized: CX1X2X3X4X5 motif 22
CVVVYQ

SEQ ID NO: 207 - protein, 6 aa, Artificial sequence
  Synthesized: CX1X2X3X4X5 motif 23
CGTVFQ

SEQ ID NO: 208 - protein, 6 aa, Artificial sequence
  Synthesized: CX1X2X3X4X5 motif 24
CTAVHQ

SEQ ID NO: 209 - protein, 6 aa, Artificial sequence
  Synthesized: CX1X2X3X4X5 motif 25
CITVHQ

SEQ ID NO: 210 - protein, 6 aa, Artificial sequence
  Synthesized: CX1X2X3X4X5 motif 26
CITAHQ

SEQ ID NO: 211 - protein, 6 aa, Artificial sequence
  Synthesized: CX1X2X3X4X5 motif 27
CVTVHQ

SEQ ID NO: 212 - protein, 6 aa, Artificial sequence
  Synthesized: CX1X2X3X4X5 motif 28
CAAVHQ

SEQ ID NO: 213 - protein, 6 aa, Artificial sequence
  Synthesized: CX1X2X3X4X5 motif 29
CGTVYQ

SEQ ID NO: 214 - protein, 6 aa, Artificial sequence
  Synthesized: CX1X2X3X4X5 motif 30
CTTVLQ

SEQ ID NO: 215 - protein, 6 aa, Artificial sequence
  Synthesized: CX1X2X3X4X5 motif 31
CTTTHQ

SEQ ID NO: 216 - protein, 6 aa, Artificial sequence
  Synthesized: CX1X2X3X4X5 motif 32
CTTDYQ

SEQ ID NO: 217 - protein, 8 aa, Artificial sequence
  Synthesized: XAXBZ motif 1
CYTYNYEF

SEQ ID NO: 218 - protein, 8 aa, Artificial sequence
  Synthesized: XAXBZ motif 2
HYTYTYDF

SEQ ID NO: 219 - protein, 8 aa, Artificial sequence
  Synthesized: XAXBZ motif 3
HYTYTYEW

SEQ ID NO: 220 - protein, 8 aa, Artificial sequence
  Synthesized: XAXBZ motif 4
KHRYTYEW

SEQ ID NO: 221 - protein, 8 aa, Artificial sequence
  Synthesized: XAXBZ motif 5
NYIYKYSF

SEQ ID NO: 222 - protein, 8 aa, Artificial sequence
  Synthesized: XAXBZ motif 6
PYIYTYQF

SEQ ID NO: 223 - protein, 8 aa, Artificial sequence
  Synthesized: XAXBZ motif 7
SFTYTYEW

SEQ ID NO: 224 - protein, 8 aa, Artificial sequence
  Synthesized: XAXBZ motif 8
SYIYIYQW

SEQ ID NO: 225 - protein, 8 aa, Artificial sequence
  Synthesized: XAXBZ motif 9
SYNYTYSW

SEQ ID NO: 226 - protein, 8 aa, Artificial sequence
  Synthesized: XAXBZ motif 10
SYSYSYEY

SEQ ID NO: 227 - protein, 8 aa, Artificial sequence
  Synthesized: XAXBZ motif 11
SYTYNYDF

SEQ ID NO: 228 - protein, 8 aa, Artificial sequence
  Synthesized: XAXBZ motif 12
SYTYNYEW

SEQ ID NO: 229 - protein, 8 aa, Artificial sequence
  Synthesized: XAXBZ motif 13
SYTYNYQF

SEQ ID NO: 230 - protein, 8 aa, Artificial sequence
  Synthesized: XAXBZ motif 14
SYVWTHNF

SEQ ID NO: 231 - protein, 8 aa, Artificial sequence
  Synthesized: XAXBZ motif 15
TYKYVYEW

SEQ ID NO: 232 - protein, 8 aa, Artificial sequence
  Synthesized: XAXBZ motif 16
TYTYTYEF

SEQ ID NO: 233 - protein, 8 aa, Artificial sequence
  Synthesized: XAXBZ motif 17
TYTYTYEW

SEQ ID NO: 234 - protein, 8 aa, Artificial sequence
  Synthesized: XAXBZ motif 18
VFTYTYEF

SEQ ID NO: 235 - protein, 6 aa, Artificial sequence
  Synthesized: XAXBZ motif 19
AYTYEW

SEQ ID NO: 236 - protein, 6 aa, Artificial sequence
  Synthesized: XAXBZ motif 20
DYIYTY

SEQ ID NO: 237 - protein, 6 aa, Artificial sequence
  Synthesized: XAXBZ motif 21
IHSYEF

SEQ ID NO: 238 - protein, 6 aa, Artificial sequence
  Synthesized: XAXBZ motif 22
SFTYEF

SEQ ID NO: 239 - protein, 6 aa, Artificial sequence
  Synthesized: XAXBZ motif 23
SHSYEF

SEQ ID NO: 240 - protein, 6 aa, Artificial sequence
  Synthesized: XAXBZ motif 24
THTYEF

SEQ ID NO: 241 - protein, 6 aa, Artificial sequence
  Synthesized: XAXBZ motif 25
TWTYEF

SEQ ID NO: 242 - protein, 6 aa, Artificial sequence
  Synthesized: XAXBZ motif 26
TYNYEW

SEQ ID NO: 243 - protein, 6 aa, Artificial sequence
  Synthesized: XAXBZ motif 27
TYSYEF

SEQ ID NO: 244 - protein, 6 aa, Artificial sequence
  Synthesized: XAXBZ motif 28
TYSYEH

SEQ ID NO: 245 - protein, 6 aa, Artificial sequence
  Synthesized: XAXBZ motif 29
TYTYDF

SEQ ID NO: 246 - protein, 6 aa, Artificial sequence
  Synthesized: XAXBZ motif 30
TYTYEF

SEQ ID NO: 247 - protein, 6 aa, Artificial sequence
  Synthesized: XAXBZ motif 31
TYTYEW

SEQ ID NO: 248 - protein, 4 aa, Artificial sequence
  Synthesized: XAXBZ motif 32
AYEF

SEQ ID NO: 249 - protein, 4 aa, Artificial sequence
  Synthesized: XAXBZ motif 33
AYSF

SEQ ID NO: 250 - protein, 4 aa, Artificial sequence
  Synthesized: XAXBZ motif 34
AYSY

SEQ ID NO: 251 - protein, 4 aa, Artificial sequence
  Synthesized: XAXBZ motif 35
CYSF

SEQ ID NO: 252 - protein, 4 aa, Artificial sequence
  Synthesized: XAXBZ motif 36
DYTY

SEQ ID NO: 253 - protein, 4 aa, Artificial sequence
  Synthesized: XAXBZ motif 37
KYEH

SEQ ID NO: 254 - protein, 4 aa, Artificial sequence
  Synthesized: XAXBZ motif 38
KYEW

SEQ ID NO: 255 - protein, 4 aa, Artificial sequence
  Synthesized: XAXBZ motif 39
MYEF

SEQ ID NO: 256 - protein, 4 aa, Artificial sequence
  Synthesized: XAXBZ motif 40
NWIY

SEQ ID NO: 257 - protein, 4 aa, Artificial sequence
  Synthesized: XAXBZ motif 41
NYDY

SEQ ID NO: 258 - protein, 4 aa, Artificial sequence
  Synthesized: XAXBZ motif 42
NYQW

SEQ ID NO: 259 - protein, 4 aa, Artificial sequence
  Synthesized: XAXBZ motif 43
NYSF

SEQ ID NO: 260 - protein, 4 aa, Artificial sequence
  Synthesized: XAXBZ motif 44
PYEW

SEQ ID NO: 261 - protein, 4 aa, Artificial sequence
  Synthesized: XAXBZ motif 45
RYNW

SEQ ID NO: 262 - protein, 4 aa, Artificial sequence
  Synthesized: XAXBZ motif 46
RYTY

SEQ ID NO: 263 - protein, 4 aa, Artificial sequence
  Synthesized: XAXBZ motif 47
SYEF

SEQ ID NO: 264 - protein, 4 aa, Artificial sequence
  Synthesized: XAXBZ motif 48
SYEH

SEQ ID NO: 265 - protein, 4 aa, Artificial sequence
  Synthesized: XAXBZ motif 49
SYEW

SEQ ID NO: 266 - protein, 4 aa, Artificial sequence
  Synthesized: XAXBZ motif 50
SYKW

SEQ ID NO: 267 - protein, 4 aa, Artificial sequence
  Synthesized: XAXBZ motif 51
SYTY

SEQ ID NO: 268 - protein, 4 aa, Artificial sequence
  Synthesized: XAXBZ motif 52
TYDF

SEQ ID NO: 269 - protein, 4 aa, Artificial sequence
  Synthesized: XAXBZ motif 53
TYEF

SEQ ID NO: 270 - protein, 4 aa, Artificial sequence
  Synthesized: XAXBZ motif 54
TYEW

SEQ ID NO: 271 - protein, 4 aa, Artificial sequence
  Synthesized: XAXBZ motif 55
TYQW

SEQ ID NO: 272 - protein, 4 aa, Artificial sequence
  Synthesized: XAXBZ motif 56
TYTY

SEQ ID NO: 273 - protein, 4 aa, Artificial sequence
  Synthesized: XAXBZ motif 57
VYEW

SEQ ID NO: 274 - protein, 48 aa, Artificial sequence; identical to SEQ ID NO: 5
  Synthesized: DH2 Germline sequence

SEQ ID NO: 275 - protein, 15 aa, Artificial sequence
  Synthesized: JH1 Germline sequence
YVDAWGQGLLVTVSS

SEQ ID NO: 276 - protein, 65 aa, Artificial sequence
  Synthesized: BLV1H12
CTSVHQETKKYQSCPDGYRERSDCSNRPACGTSDCCRVSVFGNCLTTLPVSYSYTYNYEWHVDVW

SEQ ID NO: 277 - protein, 60 aa, Artificial sequence
  Synthesized: BLV5B8
CTTVHQETRKTCSDGYIAVDSCGRGQSDGCVNDCNSCYYGWRNCRRQPAIHSYEFHVDAW

SEQ ID NO: 278 - protein, 61 aa, Artificial sequence
  Synthesized: BLV5D3
CSSVTQRTHVSRSCPDGCSDGDGCVDGCCCSAYRCYTPGVRDLSCTSYSITYTYEWNVDAW

SEQ ID NO: 279 - protein, 62 aa, Artificial sequence
  Synthesized: BLV8C11
CTTVHQKTTRKTCCSDAYRYDSGCGSGCDCCGADCYVFGACTFGLDSSYSYIYIYQWYVDAW

SEQ ID NO: 280 - protein, 60 aa, Artificial sequence
  Synthesized: BF4E9
CTTVHQIFCPDGYSYGYGCGYGYGCSGYDCYGYGGYGYGGYGGYSSYSYSYSYEYYGDAW

SEQ ID NO: 281 - protein, 70 aa, Artificial sequence
  Synthesized: B-L1
CSTVHQKTRTTQGNTCPDGYTLKDDCPRCRGGCDGYDCCWGDACRSSGLCWGHNPLVTETYTYEFYIDAW

SEQ ID NO: 282 - protein, 63 aa, Artificial sequence
  Synthesized: B-L2
CATVRQTTLRDCPGGYTEDRSCVNTYSCGADDCCGRGDVGYPALYGYRCAAHIQRYNWHADAW

SEQ ID NO: 283 - protein, 71 aa, Artificial sequence
  Synthesized: UL1
CSTVHQKTRTTQGEYLSLMVTLLKDDCPRCRGGCDGYDCCWGDACRSSGLCWGHNPLVTETYTYEFYIDAW

SEQ ID NO: 284 - protein, 71 aa, Artificial sequence
  Synthesized: UL2
CSTVHQKTRTTQGNNLSLMVTLLKDDCPRCRGGCDGYDCCWGDACRSSGLCWGHNPLVTETYTYEFYIDAW

SEQ ID NO: 285 - protein, 70 aa, Artificial sequence; identical to SEQ ID NO: 281
  Synthesized: UL3

SEQ ID NO: 286 - protein, 70 aa, Artificial sequence
  Synthesized: UL4
CSTVHQKTRTTQGNTCPDGYTFKDDCPRCRGGCDGYDCCWGDACRSSGLCWGHNPLVTETYTYEFYIDAW

SEQ ID NO: 287 - protein, 70 aa, Artificial sequence
  Synthesized: UL5
CTTVHQKTRTTQGNTCPDGYTLKDDCPRCRGGCDGYDCCWGDACRSSGLCWGHNPLVTETYTYEFYIDAW

SEQ ID NO: 288 - protein, 70 aa, Artificial sequence
  Synthesized: UL6
CSTVHQKTRTTQGNTCPDGYTLKNDCPRCRGGCDGYDCCWGDACRSSGLCWGHNPLVTETYTYEFYIDAW

SEQ ID NO: 289 - protein, 70 aa, Artificial sequence
  Synthesized: UL7
CTTVYQKTRTTQGNTCPDGYTLKDDCPRCRGGCDGYDCCWGDACRSSGLCWGHNPLVTETYTYEFYIDAW

SEQ ID NO: 290 - protein, 70 aa, Artificial sequence
  Synthesized: UL8
CSTVHQKPGQHKGILVLMVTLLKDDCPRCRGGCDGYDCCWGDACRSSGLCWGHNPLVTETYTYEFYIDAW

SEQ ID NO: 291 - protein, 70 aa, Artificial sequence
  Synthesized: UL9
CSTVHQKTRTTQGILVLMVTLLKDDCPRCRGGCDGYDCCWGDACRSSGLCWGHNPLVTETYTYEFYIDAW

SEQ ID NO: 292 - protein, 63 aa, Artificial sequence
  Synthesized: UL10
CSPVHQEIRKCCPAGCQCGRSCGACCGCAGDEFCGINVYGYVTCGGYRTCSCIDTYDFYVDAW

SEQ ID NO: 293 - protein, 63 aa, Artificial sequence
  Synthesized: UL11
CSPVHQQTRKCCPAGCQCGRSCGACCGCAGDEFCGINVYGYITCGGYRTCSCIDTYDFYVEAW

SEQ ID NO: 294 - protein, 68 aa, Artificial sequence
  Synthesized: UL12
CATVYQKTNQSKNCPEGSAWCRSCDGGAGCADYECCRCGWSGCSWRNGACECSSLSSSYTYELHVDAW

SEQ ID NO: 295 - protein, 65 aa, Artificial sequence
  Synthesized: UL13
CSTVHQTTHQIHTCPNGWTGGCVCSSRFNCRGNNCCCRTAYCSVDRYVCACPTVTYTYEFNVDSW

SEQ ID NO: 296 - protein, 65 aa, Artificial sequence
  Synthesized: UL14
CTAVYQKTTSIRSCPGGTTLRNGCRSACGCNDCDCCCGSSWDICYMSKCTSAPETYTYELHIDAW

SEQ ID NO: 297 - protein, 65 aa, Artificial sequence
  Synthesized: UL15
CTNVHQKTKKTCPDDYTCGVSCSCSSSGCADYGCCSYITYGVPGDCGGCCSYKHRYTYEWNVDAW

SEQ ID NO: 298 - protein, 63 aa, Artificial sequence
  Synthesized: UL16
CTTVHQKTKKLCPNGRTCGCGCDCGSGCCTSYCDSFGCWGGRDTFGSSCTSATYTYEWGVDAW

SEQ ID NO: 299 - protein, 64 aa, Artificial sequence
  Synthesized: UL17
CATVHQHTNKKRCPDGYEFSAGCCCGEGCSGSDCCCNSRLRCSWYEIYCSVSPSDTYEFHVDAW

SEQ ID NO: 300 - protein, 64 aa, Artificial sequence
  Synthesized: UL18
CTTVHQHTNKKRCPDGYRFSAACCCGEGCSGNECCCNTRLRCSWYEIYCSVSPSDTYEFHVDAW

SEQ ID NO: 301 - protein, 64 aa, Artificial sequence
  Synthesized: UL19
CTTVHQHTNQNRCPTGYKHSAGCCCGVGCSGNDCCCNSRLRCSWYETYCSLSPTDMYEFYVDAW

SEQ ID NO: 302 - protein, 64 aa, Artificial sequence
  Synthesized: UL20
CSTVHQHTNQNRCPAGYKHSAGCCCGVGCSGNDCCCNSRLRCSWYETYCSLSPTDMYEFYVDAW

SEQ ID NO: 303 - protein, 63 aa, Artificial sequence
  Synthesized: UL21
CTTVHQKTNERCCRVVSDDGECGDGNSCHRWLCSDYCYSGDCCACGCRAYHYTYTYEWNIDAW

SEQ ID NO: 304 - protein, 63 aa, Artificial sequence
  Synthesized: UL22
CTTVHQKTNERCCRVVSDDGECGDGNSCHRWLCSDYCYSGDCCACGCRAYHYTYTYDFRIDVW

SEQ ID NO: 305 - protein, 64 aa, Artificial sequence
  Synthesized: UL23
CTTVHQKTNRERCCPDGYYYCCRSVSDCCCSTRACVGDSCGWTDFGSTHNVDCSFTYEFHVDAW

SEQ ID NO: 306 - protein, 63 aa, Artificial sequence
  Synthesized: UL24
CTTVHQQTRKSCPDGYTYCHDCGYGCCCGASFCRDYGGCGSLCGRYCTSFDYIYTYENYVETW

SEQ ID NO: 307 - protein, 64 aa, Artificial sequence
  Synthesized: UL25
CTTVHQETKKNCPDNCYYENSCGDYGSGCNGGDCCRCGTWLTCSVSGCTCIRATNTYQWYVNAW

SEQ ID NO: 308 - protein, 64 aa, Artificial sequence
  Synthesized: UL26
CTTVHQSTNKKSCPDRVCWAVGCCFGEDCTSSDCTCYASPGNPYRHDCGNCDCRSSYEHHVDAW

SEQ ID NO: 309 - protein, 63 aa, Artificial sequence
  Synthesized: UL27
CTTVRQETLIRCRDGPSCAACCRSGRRCSGYGCCTDGCCSDNDYADCIRGEFVDVYEWNVDAW

SEQ ID NO: 310 - protein, 63 aa, Artificial sequence
  Synthesized: UL28
CSTVYQKTRTTCPDGYTCGDGARCEKACRGCDCCRTTVCDTVWSSYCSCYSFTDSYEFYVDAW

SEQ ID NO: 311 - protein, 66 aa, Artificial sequence
  Synthesized: UL29
CATVYQKTNREMSCPDGCRIHNARLCLSGCSGSDCCSCGDCVSDARCYNCRSAVFTYTYEFHVDAW

SEQ ID NO: 312 - protein, 63 aa, Artificial sequence
  Synthesized: UL30
CTIVHQETKRSCPDGYNTGTRCFGSCGCIGSNCCRSTTSCCCAGIYSQCTTSTLTYEWHADVW

SEQ ID NO: 313 - protein, 63 aa, Artificial sequence
  Synthesized: UL31
CAIVYQRTRQRCPDGYNTGTRCFGTCGCNGSNCCRFTTSCCCAGVYSQCTTSTLTYEWHADVW

SEQ ID NO: 314 - protein, 63 aa, Artificial sequence
  Synthesized: UL32
CTTVHQKTETRCPDGYSSTNGCDARCGCSDCDCCNVGRWGCPLICSRNCRSFTYTYEWYADAW

SEQ ID NO: 315 - protein, 63 aa, Artificial sequence
  Synthesized: UL33
CTTVHQKTNKKESCPDGYTMNECCGCGYGCCRGGCVCSAYCSRPNCWRELTYTYTYEFYVDTW

SEQ ID NO: 316 - protein, 63 aa, Artificial sequence
  Synthesized: UL34
CTTVYQKSRKESSCPNGWIYGKDCCSWSYCTDCDCCLCGDLHCYDGCSSFGVTWTYEFHVDAW

SEQ ID NO: 317 - protein, 62 aa, Artificial sequence
  Synthesized: UL35
CTTVFQETRKSCPTGFYVDGSTCGCATYCRTCDCCGGYRCSGGGSCACSSYTYNYDFHVDAW

SEQ ID NO: 318 - protein, 61 aa, Artificial sequence
  Synthesized: UL36
CAAVFQETRTNCPSGYGNAFSCGCPIACRDCDCCGGYWCSGGADCHCVSYNYTYSWHVDAW

SEQ ID NO: 319 - protein, 62 aa, Artificial sequence
  Synthesized: UL37
CATVYQKTEKHCPLFHSICCHCGEGVGCSGGDCCGCERRSGCVVCTMRNSYTYNYQFHVDAW

SEQ ID NO: 320 - protein, 63 aa, Artificial sequence
  Synthesized: UL38
CGTVHQKTKELCPDDSTYCCGCVSGCACCTYGCDGVGCCRVSLWTTYIKDIVGVSYEWHVDAW

SEQ ID NO: 321 - protein, 61 aa, Artificial sequence
  Synthesized: UL39
CASVHQHTEPTCPAGYTYCCGCLYKCNCGDCGCYNVGCGSGWLGKACGDYRETYEWYVDAW

SEQ ID NO: 322 - protein, 61 aa, Artificial sequence
  Synthesized: UL40
CASVHQHTEPTCPAGYTYCCGCLYKCNCGDCGCYNAGCGSGWLGKACGDYRETYEWYVDAW

SEQ ID NO: 323 - protein, 61 aa, Artificial sequence
  Synthesized: UL41
CTTVFQETRKSCPSGFRDRDACGCAVTCRNCDCCGGGPCNGGGSCRCNNYIYKYSFHVDAW

SEQ ID NO: 324 - protein, 61 aa, Artificial sequence
  Synthesized: UL42
CTAVFQETRKDCPSGYGSAFTCGCLAACHGCDCCGGGWCSGGGDCRCRSYSTAYSFHIDAW

SEQ ID NO: 325 - protein, 61 aa, Artificial sequence
  Synthesized: UL43
CATVFQETRKSCPSGYADRFTCDCVYYCQTCDCCGGNRCSGGGPCRCSSYSINYSFHVDTW

SEQ ID NO: 326 - protein, 58 aa, Artificial sequence
  Synthesized: UL44
CAAAHQETKKSCPDGTCRQCCGGVCRCHASGCCYWCTTGCVGRALSESHSYEFHVDTW

SEQ ID NO: 327 - protein, 70 aa, Artificial sequence; identical to SEQ ID NO: 281
  Synthesized: UL45

SEQ ID NO: 328 - protein, 68 aa, Artificial sequence
  Synthesized: UL46
CVVVYQKTNSQKSCPRGYTERETCNRRYGWGCGRYDCCDCDRWVSGNCANICTDYTDTHTYEFHADAW

SEQ ID NO: 329 - protein, 64 aa, Artificial sequence
  Synthesized: UL47
CGTVFQQTHKVRDCPDGFTAAPRCGGECCCSNVNSRSGGWCRYCGRDCTAPTETSTYEFHVDAW

SEQ ID NO: 330 - protein, 63 aa, Artificial sequence
  Synthesized: UL48
CTAVYQRTGQKCPEGCESRNTCLYSRNCGDYTCCGGSRASGSGACGWNSVDCKNKYEHHVDAW

SEQ ID NO: 331 - protein, 63 aa, Artificial sequence
  Synthesized: UL49
CTTVYQKTKQNCPDGYDFRDTCGSQSYCSGYDCCRCSRFGGCSIGTCISYSDAYTYEWYVDAW

SEQ ID NO: 332 - protein, 63 aa, Artificial sequence
  Synthesized: UL50
CTTVHQQTHEKRSCPESYSYSCSCASGVVGCGPDDCCCTYRISIRGYTCSSLSNSYEWYVDAW

SEQ ID NO: 333 - protein, 61 aa, Artificial sequence
  Synthesized: UL51
CTAVHQQTKRKSGCPDGYSDESCSYCGSSWCCPVYWCGSPCSYRCLRHTDTYSYEHHVDAW

SEQ ID NO: 334 - protein, 60 aa, Artificial sequence
  Synthesized: UL52
CATVYQETKRTCAGGHSVECDSPYDCNCRGGDCCRSPIFNDCWAASCSATKTYEWHVESW

SEQ ID NO: 335 - protein, 58 aa, Artificial sequence
  Synthesized: UL53
CITVHQETQKSCPDDYTYYGDGTCAYVCSIDKCCCGRTWLSSGCLPCRYTYNLHVDAW

SEQ ID NO: 336 - protein, 58 aa, Artificial sequence
  Synthesized: UL54
CITVHQETQKSCPDDYTSYGDATCAYVCSTDECCCGRTWLSAGCRPCRYTYNLHVDAW

SEQ ID NO: 337 - protein, 58 aa, Artificial sequence
  Synthesized: UL55
CITVHQETQKSCFDDYTYYGDASCAYVCSTDECCCGRTWLSAGCRPCRYTYNLHVDAW

SEQ ID NO: 338 - protein, 58 aa, Artificial sequence
  Synthesized: UL56
CITAHQETQKSCSDDYTYYGDATCAYVCSTDECCCGRTWLSAGCRPCRYTYNLHVDAW

SEQ ID NO: 339 - protein, 58 aa, Artificial sequence
  Synthesized: UL57
CITVHQETQKSCPDDYTYYGDGTCAYVCSIDNCCCGRTWLSSGCLPCRYTYNLHVDAW

SEQ ID NO: 340 - protein, 61 aa, Artificial sequence
  Synthesized: UL58
CVTVHQQTHATRRCPDGYGDSYACKSNYGCSAEGCCRWGPGSGACTGAIYTSPYEWYVDAW

SEQ ID NO: 341 - protein, 60 aa, Artificial sequence
  Synthesized: UL59
CAAVHQRTEGQQSCPDGYLETRVCPYRMYRCIGWDCCRCSDGSRDNYIMTYSYEFHVDVW

SEQ ID NO: 342 - protein, 59 aa, Artificial sequence
  Synthesized: UL60
CTTVYQETKTKSGCPDGYSCCYNGRSRSCRPNDCSTYGEVRSLSRSCYTYNYEFYVDAW

SEQ ID NO: 343 - protein, 58 aa, Artificial sequence
  Synthesized: UL61
CGTVYQHTKEIKTCPDGYSDVFTYCPVTCPGWDCCRRNDCGRTRYTVAYSYALHVDVW

SEQ ID NO: 344 - protein, 57 aa, Artificial sequence
  Synthesized: UL62
CTTVLQETHQQRGCPAGYQVVDGCPYGDCCRTSYVCGPLTCTSNTATRNYQWYVDAW

SEQ ID NO: 345 - protein, 56 aa, Artificial sequence
  Synthesized: UL63
CSTVYQKTEKKCPDGYTDRRDECPNTCKNFDCENEGGLRCLCSAYISAYEFHVDAW

SEQ ID NO: 346 - protein, 55 aa, Artificial sequence
  Synthesized: UL64
CTTTHQRTQKSCPDYASYDCGSPDDEECSSCRSCTRWCAPTAPYIYTYQFYIDAW

SEQ ID NO: 347 - protein, 54 aa, Artificial sequence
  Synthesized: UL65
CTTVHQQTNKRCPTGYNSGTLCNMIGCSGDECCNYGRVECTSYVWTHNFYVDAW

SEQ ID NO: 348 - protein, 53 aa, Artificial sequence
  Synthesized: UL66
CTTVHQETQRTSCPSGWTYTCNCRNGCGCYRPSQLCGAYVAVTHTYEFHVDAW

SEQ ID NO: 349 - protein, 53 aa, Artificial sequence
  Synthesized: UL67
CATVHQKDKHCPAGYRSGTLCRMIGCTGDDCCNYDRVECTNYDYTNNFYVDAW

SEQ ID NO: 350 - protein, 52 aa, Artificial sequence
  Synthesized: UL68
CTAVHQQTTEKGKTCPPRSRDMGTRCRDDRYYPWRYSDYTYTYTYEWHVDAW

SEQ ID NO: 351 - protein, 51 aa, Artificial sequence
  Synthesized: UL69
CTSVHQKTDVTCPSGATYRCDCGGRGCGCYDPWCSTTYRGTYTYDFHVETW

SEQ ID NO: 352 - protein, 50 aa, Artificial sequence
  Synthesized: UL70
CGTVHQETHTQRTCPDACDVTGDNCKVRRNGDWCGRASKTDTYDFYVDAW

SEQ ID NO: 353 - protein, 49 aa, Artificial sequence
  Synthesized: UL71
CTTDYQKTEKSCPENYYAETGYCMCGSWRCGYGSTTSLIVSYKWYVDAW

SEQ ID NO: 354 - protein, 49 aa, Artificial sequence
  Synthesized: UL72
CTTVHQKTNQKWGCPDGYVHMSGSCCRGSICTNGLFRNTYTYEFNVEAW

SEQ ID NO: 355 - protein, 48 aa, Artificial sequence
  Synthesized: UL73
CTTVYQETRTNCPDGYNYRSGDCRRWNHWLGEQRVSPTYNYEWYVDSW

SEQ ID NO: 356 - protein, 47 aa, Artificial sequence
  Synthesized: UL74
CTTVYQKTTTTKSCPGGFDNGRRCIMGLGDLRDYTYFNKYEWYVETW

SEQ ID NO: 357 - protein, 46 aa, Artificial sequence
  Synthesized: UL75
CSTVHQKTEQRCLDGYDDRGAYCYDSVRGLMSWTYKYVYEWRVDTW

SEQ ID NO: 358 - protein, 45 aa, Artificial sequence
  Synthesized: UL76
CTNVHQMTIKTCPDGGSYGWYWPYGYGCNGGVSATYTYEFYVDAW

SEQ ID NO: 359 - protein, 44 aa, Artificial sequence
  Synthesized: UL77
CTTVYQKTESVRSCPDGSMDGWRCRLGTMNWIYSNTYEFYVDAW

SEQ ID NO: 360 - protein, 75 aa, Artificial sequence
  Synthesized: BLV1H12
CTSVHQETKKYQSCPDGYRERSDCSNRPACGTSDCCRVSVFGNCLTTLPVSYSYTYNYEWHVDVWGQGLLVTVSS

SEQ ID NO: 361 - protein, 70 aa, Artificial sequence
  Synthesized: BLV5B8
CTTVHQETRKTCSDGYIAVDSCGRGQSDGCVNDCNSCYYGWRNCRRQPAIHSYEFHVDAWGRGLLVTVSS

SEQ ID NO: 362 - protein, 71 aa, Artificial sequence
  Synthesized: BLV5D3
CSSVTQRTHVSRSCPDGCSDGDGCVDGCCCSAYRCYTPGVRDLSCTSYSITYTYEWNVDAWGRGLLVTVSS

SEQ ID NO: 363 - protein, 72 aa, Artificial sequence
  Synthesized: BLV8C11
CTTVHQKTTRKTCCSDAYRYDSGCGSGCDCCGADCYVFGACTFGLDSSYSYIYIYQWYVDAWGQGLLVTVSS

SEQ ID NO: 364 - protein, 70 aa, Artificial sequence
  Synthesized: BF4E9
CTTVHQIFCPDGYSYGYGCGYGYGCSGYDCYGYGGYGYGGYGGYSSYSYSYSYEYYGDAWGQGLLVTVSS

SEQ ID NO: 365 - protein, 50 aa, Artificial sequence
  Synthesized: BF1H1
CTTVHPSPDGYSYGYGCGYGYGCSGYDCYGYGGYGYGGYGGYSSYSYSYS

SEQ ID NO: 366 - protein, 50 aa, Artificial sequence
  Synthesized: F18
CTTVHQIRCPDGYGYGYGCGYGSYGYSGYDCYGYGGYGGYGGYGGYSSYS

SEQ ID NO: 367 - DNA, 300 bp, Artificial sequence
  Synthesized: Bovine VH-UL
caggtgcagctgcgggagtcgggccccagcctggtgaagccctcacagaccctctcgctcacctgcacggcctctggattctcattgagcgacaaggctgtaggctgggtccgccaggctccagggaaggcgctggagtggctcggtggtatagacactggtggaagcacaggctataacccaggcctgaaatcccggctcagcatcaccaaggacaactccaagagccaagtctctctgtcagtgagcagcgtgacaactgaggactcggccacatactactgtactactgtgcaccag

SEQ ID NO: 368 - DNA, 311 bp, Artificial sequence
  Synthesized: 4-39
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacacacagtgagggg

SEQ ID NO: 369 - DNA, 288 bp, Artificial sequence
  Synthesized: 4-59*03
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccaattctccctgaagctgagctctgtgaccgctgcggacacggccgtgtattactgtgcg

SEQ ID NO: 370 - DNA, 291 bp, Artificial sequence
  Synthesized: 4-34*09
caggtgcagctgcaggagtcgggcccaggactggtgaagccttcacagaccctgtccctcacctgcgctgtctatggtgggtccttcagtggttactactggagctggatccgccagcccccagggaagggactggagtggattggggaaatcaatcatagtggaagcaccaactacaacccgtccctcaagagtcgagttaccatatcagtagacacgtctaagaaccagttctccctgaagctgagctctgtgactgccgcggacacggccgtgtattactgtgcgaga

SEQ ID NO: 371 - DNA, 293 bp, Artificial sequence
  Synthesized: 4-34*02
caggtgcagctacaacagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagg

SEQ ID NO: 372 - DNA, 330 bp, Artificial sequence
  Synthesized: BLV1H12 VL
caggctgtgctgaatcagccatcatccgtgtccgggtccctgggccagagggtctccatcacctgctctggaagcagcagcaatgttggaaatggatatgtgagctggtaccaactgatcccaggatcggcccccagaaccctcatctatggtgacaccagtcgagcctcgggggtccccgaccgattctccggctccaggtctgggaacacagccaccctgaccatcagctcgctccaggctgaggacgaggcagattatttctgtgcatctgctgaggatagtagcagtaatgctgttttcggcagcgggaccacactgaccgtcctg

SEQ ID NO: 373 - DNA, 296 bp, Artificial sequence
  Synthesized: Vl1-47
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtcc

SEQ ID NO: 374 - DNA, 299 bp, Artificial sequence
  Synthesized: Vl1-40*1
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttc

SEQ ID NO: 375 - DNA, 296 bp, Artificial sequence
  Synthesized: Vl1-51 *01
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgg

SEQ ID NO: 376 - DNA, 297 bp, Artificial sequence
  Synthesized: Vl2-18*02
cagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagctcatatacaagcagcagcactttc

SEQ ID NO: 377 - DNA, 514 bp, Artificial sequence
  Synthesized: partially human antibody comprising an ultralong CDR3
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtactactgtgcaccaggaaacaaaaaaataccaaagttgtcctgatgggtatagagaacgttcggattgtagtaacagacctgcttgtggtactagtgattgttgtcgtgttagtgtttttggtaattgtcttactactcttcctgtgagttatagttatacttacaattacgaatggcacgtcgatgtctggggccagggaaccctggtcaccgtctcctcag

SEQ ID NO: 378 - protein, 171 aa, Artificial sequence
  Synthesized: partially human antibody comprising an ultralong CDR3 amino acid sequence
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCTTVHQETKKYQSCPDGYRERSDCSNRPACGTSDCCRVSVFGNCLTTLPVSYSYTYNYEWHVDVWGQGTLVTVSS

SEQ ID NO: 379 - DNA, 493 bp, Artificial sequence
  Synthesized: partially human antibody V region comprised of an ultralong CDR3
caggtgcagctacaacagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtactactgtgcaccaggaaaccagaaaaacctgttctgatggttatatggctgtagatagttgtggtcgtggtcagagtgatggttgtgtcaatgattgcaattgttgttattatggttggcggaactgtcgcaggcagcctgcaattcaaagttacgaatttcacgtcgatgcctggggccgtggcaccctggtcactgtctcctcag

SEQ ID NO: 380 - protein, 164 aa, Artificial sequence
  Synthesized: partially human antibody V region comprised of an ultralong CDR3
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCTTVHQETRKTCSDGYMAVDSCGRGQSDGCVNDCNCCYYGWRNCRRQPAIQSYEFHVDAWGRGTLVTVSS

SEQ ID NO: 381 - DNA, 63 bp, Artificial sequence
  Synthesized: MID1 FW
cctatcccctgtgtgccttggcagtctcagacgagtgcgtttgagcgacaaggctgtaggctg

SEQ ID NO: 382 - DNA, 62 bp, Artificial sequence
  Synthesized: MID1 RV
ccatctcatccctgcgtgtctccgactcagacgagtgcgtctttcggggctgtggtggaggc

SEQ ID NO: 383 - DNA, 63 bp, Artificial sequence
  Synthesized: MID10 FW
cctatcccctgtgtgccttggcagtctcagtctctatgcgttgagcgacaaggctgtaggctg

SEQ ID NO: 384 - DNA, 66 bp, Artificial sequence
  Synthesized: MID10 RV
ccatctcatccctgcgtgtctccgactcagtctctatgcgagtgaagactctcgggtgtgattcac

SEQ ID NO: 385 - DNA, 63 bp, Artificial sequence
  Synthesized: MID11 FW
cctatcccctgtgtgccttggcagtctcagtgatacgtctttgagcgacaaggctgtaggctg

SEQ ID NO: 386 - DNA, 66 bp, Artificial sequence
  Synthesized: MID11 RV
ccatctcatccctgcgtgtctccgactcagtgatacgtctagtgaagactctcgggtgtgattcac

SEQ ID NO: 387 - DNA, 23 bp, Artificial sequence
  Synthesized: primer 1 for bovine VH region
ttgagcgacaaggctgtaggctg

SEQ ID NO: 388 - DNA, 22 bp, Artificial sequence
  Synthesized: primer 2 for bovine VH region
ctttcggggctgtggtggaggc

SEQ ID NO: 389 - DNA, 20 bp, Artificial sequence
  Synthesized: sequencing primer
agatccaagctgtgaccggc

SEQ ID NO: 390 - DNA, 1002 bp, Artificial sequence
  Synthesized: CH1 CH2 CH3 of human IgG1
  CDS (1)..(1002)
gctagcaccaagggcccatcggtcttccccctggcaccctcctccaagagcacctctgggggcacagcggccctgggctgcctggtcaaggactacttccccgagccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataatctaga

SEQ ID NO: 391 - protein, 330 aa, Artificial sequence [sequence omitted]

SEQ ID NO: 392 - DNA, 513 bp, Artificial sequence
  Synthesized: BLV1H12 V region
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagctgtcctgacggctatcgggagagatctgattgcagtaataggccagcttgtggcacatccgactgctgtcgcgtgtctgtcttcgggaactgcctgactaccctgcctgtgtcctactcttatacctacaattatgaatggcatgtggatgtctggggacagggcctgctggtgacagtctctagtgctagc

SEQ ID NO: 393 - DNA, 1563 bp, Artificial sequence
  Synthesized: (Sig Seq- VRegion - CH1CH2CH3) BLV1H12 V in human IgG
  CDS (1)..(1563)
atgcgcaggatgcaactcctgttgctgattgcactaagtcttgcacttgtcacgaattcgcaggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagctgtcctgacggctatcgggagagatctgattgcagtaataggccagcttgtggcacatccgactgctgtcgcgtgtctgtcttcgggaactgcctgactaccctgcctgtgtcctactcttatacctacaattatgaatggcatgtggatgtctggggacagggcctgctggtgacagtctctagtgctagcaccaagggcccatcggtcttccccctggcaccctcctccaagagcacctctgggggcacagcggccctgggctgcctggtcaaggactacttccccgagccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 394 - protein, 519 aa, Artificial sequence [sequence omitted]

SEQ ID NO: 395 - DNA, 1470 bp, Artificial sequence
  Synthesized: BLV1H12 V in human IgG with BsaI cassette in CDR3
  CDS (1)..(1470)
atgcgcaggatgcaactcctgttgctgattgcactaagtcttgcacttgtcacgaattcgcaggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcgagacctactatggttcgggtctctcttatacctacaattatgaatggcatgtggatgtctggggacagggcctgctggtgacagtctctagtgctagcaccaagggcccatcggtcttccccctggcaccctcctccaagagcacctctgggggcacagcggccctgggctgcctggtcaaggactacttccccgagccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 396 - protein, 488 aa, Artificial sequence [sequence omitted]

SEQ ID NO: 397 - DNA, 258 bp, Artificial sequence
  Synthesized: IL-8 26-99 Insert
  CDS (1)..(258)
aattcgggtctcaagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcatcttatgagaccagctaa

SEQ ID NO: 398 - protein, 85 aa, Artificial sequence
  Synthetic Construct
NSGLKSPRSAKELRCQCIKTYSKPFHPKFIKELRVIESGPHCANTEIIVKLSDGRELCLDPKENWVQRVVEKFLKRAENSSYETS

SEQ ID NO: 399 - DNA, 267 bp, Artificial sequence
  Synthesized: IL8 26-99 + GlySerGly Linker Insert
  CDS (1)..(267)
aattcgggtctcaagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatgagaccagctaa

SEQ ID NO: 400 - protein, 88 aa, Artificial sequence
  Synthetic Construct
NSGLKSPRSAKELRCQCIKTYSKPFHPKFIKELRVIESGPHCANTEIIVKLSDGRELCLDPKENWVQRVVEKFLKRAENSGSGSYETS

SEQ ID NO: 401 - DNA, 435 bp, Artificial sequence
  Synthesized: IL-21 Insert
  CDS (1)..(435)
aattcgggtctcaagagccaaggtcaagatcgccacatgatcagaatgcgtcagctcatagatattgttgatcagctgaagaactacgtgaacgacttggtccctgaatttctgccagctcccgaagatgtagagacaaactgtgagtggtcagccttctcctgctttcagaaggcccaactaaagtcagcaaataccggcaacaacgagaggataatcaatgtatcaatcaaaaagctgaagaggaagccaccttccacaaatgcagggagacggcagaaacaccgcctgacatgcccttcatgtgattcttacgagaagaagccacccaaagagttcctagagcggttcaagtcacttctcgacaagatgattgatcagcatctgtcctctcgcacacacggaagtgaagattcctcttatgagaccagctaa

SEQ ID NO: 402 - protein, 144 aa, Artificial sequence
  Synthetic Construct
NSGLKSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLDKMIDQHLSSRTHGSEDSSYETS

SEQ ID NO: 403 - DNA, 435 bp, Artificial sequence; identical to SEQ ID NO: 401
  Synthesized: IL-21 (Q116D, H120D) Insert
  CDS (1)..(435)

SEQ ID NO: 404 - protein, 144 aa, Artificial sequence; identical to SEQ ID NO: 402
  Synthetic Construct

SEQ ID NO: 405 - DNA, 249 bp, Artificial sequence
  Synthesized: SDF-1alpha-GSG Insert
aattcgggtctcaagagcaagcccgtcagcctgagctacagatgcccatgccgattcttcgaaagccatgttgccagagccaacgtcaagcatctcaaaattctcaacactccaaactgtgcccttcagattgtagcccggctgaagaacaacaacagacaagtgtgcattgacccgaagctaaagtggattcaggagtacctggagaaagctttaaacaagggcagcggttcttatgagaccagctaa

SEQ ID NO: 406 - DNA, 78 bp, Artificial sequence
  Synthesized: Somatostatin-14
  CDS (1)..(78)
aattcgggtctcaagagcgctggctgcaagaatttcttctggaagactttcacatcctgttcttatgagaccagctaa

SEQ ID NO: 407 - protein, 25 aa, Artificial sequence
  Synthetic Construct
NSGLKSAGCKNFFWKTFTSCSYETS

SEQ ID NO: 408 - DNA, 126 bp, Artificial sequence
  Synthesized: ProTx-II Insert
  CDS (1)..(126)
aattcgggtctcaagagctattgccagaagtggatgtggacctgcgatagcgaacggaaatgttgcgaaggcatggtgtgccgcctgtggtgcaagaagaaactctggtcttatgagaccagctaa

SEQ ID NO: 409 - protein, 41 aa, Artificial sequence
  Synthetic Construct
NSGLKSYCQKWMWTCDSERKCCEGMVCRLWCKKKLWSYETS

SEQ ID NO: 410 - DNA, 138 bp, Artificial sequence
  Synthesized: Chlorotoxin Insert
aattcgggtctcaagagcatgtgtatgccctgcttcacgaccgatcaccagatggcgcgcaaatgcgatgactgttgcggcggtaaaggtcgcggaaagtgctatggcccgcagtgtctgtcttatgagaccagctaa

SEQ ID NO: 411 - DNA, 111 bp, Artificial sequence
  Synthesized: Ziconotide Insert
aattcgggtctcaagagctgcaagggcaaaggtgcgaaatgcagccgcctgatgtatgattgctgtaccgggtcctgccgcagtggcaagtgctcttatgagaccagctaa

SEQ ID NO: 412 - DNA, 672 bp, Artificial sequence
  Synthesized: BLV1H12 Light Chain
  CDS (1)..(672)
tcacgaattcgcaggccgtcctgaaccagccaagcagcgtctccgggtctctggggcagcgggtctcaatcacctgtagcgggtcttcctccaatgtcggcaacggctacgtgtcttggtatcagctgatccctggcagtgccccacgaaccctgatctacggcgacacatccagagcttctggggtccccgatcggttctcagggagcagatccggaaacacagctactctgaccatcagctccctgcaggctgaggacgaagcagattatttctgcgcatctgccgaggactctagttcaaatgccgtgtttggaagcggcaccacactgacagtcctggggcagcccaagagtcccccttcagtgactctgttcccaccctctaccgaggaactgaacggaaacaaggccacactggtgtgtctgatcagcgacttttaccctggatccgtcactgtggtctggaaggcagatggcagcacaattactaggaacgtggaaactacccgcgcctccaagcagtctaatagtaaatacgccgccagctcctatctgagcctgacctctagtgattggaagtccaaagggtcatatagctgcgaagtgacccatgaaggctcaaccgtgactaagactgtgaaaccatccgagtgctcctaggctagctggc

SEQ ID NO: 413 - protein, 7 aa, Artificial sequence
  Synthetic Construct
SRIRRPS

SEQ ID NO: 414 - protein, 34 aa, Artificial sequence
  Synthetic Construct
TSQAASPGLWGSGSQSPVAGLPPMSATATCLGIS

SEQ ID NO: 415 - protein, 8 aa, Artificial sequence
  Synthetic Construct
SLAVPHEP

SEQ ID NO: 416 - protein, 25 aa, Artificial sequence
  Synthetic Construct
STATHPELLGSPIGSQGADPETQLL

SEQ ID NO: 417 - protein, 32 aa, Artificial sequence
  Synthetic Construct
PSAPCRLRTKQIISAHLPRTLVQMPCLEAAPH

SEQ ID NO: 418 - protein, 11 aa, Artificial sequence
  Synthetic Construct
QSWGSPRVPLQ

SEQ ID NO: 419 - protein, 9 aa, Artificial sequence
  Synthetic Construct
LCSHPLPRN

SEQ ID NO: 420 - protein, 9 aa, Artificial sequence
  Synthetic Construct
TETRPHWCV

SEQ ID NO: 421 - protein, 42 aa, Artificial sequence
  Synthetic Construct
SATFTLDPSLWSGRQMAAQLLGTWKLPAPPSSLIVNTPPAPI

SEQ ID NO: 422 - protein, 14 aa, Artificial sequence
  Synthetic Construct
PLVIGSPKGHIAAK

SEQ ID NO: 423 - protein, 6 aa, Artificial sequence
  Synthetic Construct
PMKAQP

SEQ ID NO: 424 - protein, 10 aa, Artificial sequence
  Synthetic Construct
NHPSAPRLAG

SEQ ID NO: 425 - DNA, 641 bp, Artificial sequence
  Synthesized: VH1-24+CDR3-IL8
tcacgaattcgcaggtccagctggtacagtctggggctgaggtgaagaagcctggggcctcagtgaaggtgtcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgcacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 426 - DNA, 641 bp, Artificial sequence
  Synthesized: VH1-46+CDR3-IL8
tcacgaattcgcaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgcacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 427 - DNA, 641 bp, Artificial sequence
  Synthesized: VH1-69+CDR3-IL8
tcacgaattcgcaggtgcagctggtgcagtctggggctgaggtgaagaagcctgggtcctcggtgaaggtgtcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgcacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 428 - DNA, 641 bp, Artificial sequence
  Synthesized: VH3-23+CDR3-IL8
tcacgaattcggaggtgcagctgttggagtctgggggaggcttggtacagcctggggggtccctgagactctcctgtgcagcctctggattcacctttagcagctatgccatgagctgggtccgccaggctccagggaaggggctggagtgggtgagcgcaattagtggtagtggcggtagcacatactacgcagactccgtgaagggccggttcaccatctcacgtgacaattccaagaacacgctgtatctgcaaatgaacagcctgagagccgaggacacggccgtgtattactgcacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 429 - DNA, 638 bp, Artificial sequence
  Synthesized: VH4-4+CDR3-IL8
tcacgaattcgcaggtgcagctgcaggagtcgggcccaggactggtgaagccttcggagacgctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgcacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 430 - DNA, 638 bp, Artificial sequence
  Synthesized: VH4-34+CDR3-IL8
tcacgaattcgcaggtgcagctacagcagtggggcgcaggactgttgaagccttcggagacgctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 431 - DNA, 431 bp, Artificial sequence
  Synthesized: IgGVH4-4 CDR3 BsaI (lacking the IL-8 insert)
tcacgaattcgcaggtgcagctgcaggagtcgggcccaggactggtgaagccttcggagacgctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgcacctctgtgcaccaggaaactaagaaataccagagcgagacctactatggttcgggtctctcttatacctacaattatgaatggcatgtggatgtctggggacagggcctgctggtgacagtctctagtgctagc

SEQ ID NO: 432 - DNA, 638 bp, Artificial sequence
  Synthesized: VH4-34+CDR3-IL8_CDR1 Cow
tcacgaattcgcaggtgcagctacagcagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 433 - DNA, 638 bp, Artificial sequence
  Synthesized: VH4-34+CDR3-IL8_CDR2 Cow
tcacgaattcgcaggtgcagctacagcagtggggcgcaggactgttgaagccttcggagacgctgtccctcacctgcgctgtctatggtgggtccttcagtggttactactggagctggattcgccagcccccagggaaggggctggagtggctgggcagcatcgataccggcgggaacacagggtacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 434 - DNA, 638 bp, Artificial sequence
  Synthesized: VH4-34+CDR3-IL8_CDR1 G31D, Y32K
tcacgaattcgcaggtgcagctacagcagtggggcgcaggactgttgaagccttcggagacgctgtccctcacctgcgctgtctatggtgggtccttcagtgacaagtactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 435 - DNA, 638 bp, Artificial sequence
  Synthesized: VH4-34+CDR3-IL8_CDR2 E50S
tcacgaattcgcaggtgcagctacagcagtggggcgcaggactgttgaagccttcggagacgctgtccctcacctgcgctgtctatggtgggtccttcagtggttactactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 436 - DNA, 638 bp, Artificial sequence
  Synthesized: VH4-34+CDR3-IL8_CDR1 Cow_CDR2 Cow
tcacgaattcgcaggtgcagctacagcagtggggcgcaggactgttgaagccttcggagacgctgtccctcacctgcacagcaagcgggttttcactgagcgacaaggcagtgggatggattcgccagcccccagggaaggggctggagtggctgggcagcatcgataccggcgggaacacagggtacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 437 - DNA, 638 bp, Artificial sequence
  Synthesized: VH4-34+CDR3-IL8_CDR1 Cow_CDR2 E50S
tcacgaattcgcaggtgcagctacagcagtggggcgcaggactgttgaagccttcggagacgctgtccctcacctgcacagcaagcgggttttcactgagcgacaaggcagtgggatggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 438 - DNA, 638 bp, Artificial sequence
  Synthesized: VH4-34+CDR3-IL8_CDR1 G31D,Y32K_CDR2 Cow
tcacgaattcgcaggtgcagctacagcagtggggcgcaggactgttgaagccttcggagacgctgtccctcacctgcgctgtctatggtgggtccttcagtgacaagtactggagctggattcgccagcccccagggaaggggctggagtggctgggcagcatcgataccggcgggaacacagggtacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 439 - DNA, 638 bp, Artificial sequence
  Synthesized: VH4-34+CDR3-IL8_CDR1 G31D,Y32K_CDR2 E50S
tcacgaattcgcaggtgcagctacagcagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 440 - DNA, 671 bp, Artificial sequence
  Synthesized: V1-51, I29V, N32G
tcacgaattcgcagtccgtgctgacccaacccccgtcagtgtctgctgcccccgggcagaaggtgactatcagctgctctggctcatcctccaatgtcggcaacggctacgtcagctggtaccagcagctgcctggaacagctcctaaactgctcatttatgacaataacaagcgcccatccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 441 - DNA, 671 bp, Artificial sequence
  Synthesized:  V1-51, DNN (aa51-53) changed to GDT
tcacgaattcgcagtccgtgctgacccaacccccgtcagtgtctgctgcccccgggcagaaggtgactatcagctgctctggctcatcaagcaacatcgggaataattacgtcagctggtaccagcagctgcctggaacagctcctaaactgctcatttatggcgacacaaagcgcccatccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 442 - DNA, 671 bp, Artificial sequence
  Synthesized: V1-51, DNNKRP (aa51-56) changed to GDTSRA
tcacgaattcgcagtccgtgctgacccaacccccgtcagtgtctgctgcccccgggcagaaggtgactatcagctgctctggctcatcaagcaacatcgggaataattacgtcagctggtaccagcagctgcctggaacagctcctaaactgctcatttatggcgacacatccagagcttccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 443 - DNA, 671 bp, Artificial sequence
  Synthesized: V1-51, S2A,T5N,P8S,A12G,A13S, and P14L
tcacgaattcgcaggccgtcctgaaccagccaagcagcgtctccgggtctctggggcagaaggtgactatcagctgctctggctcatcaagcaacatcgggaataattacgtcagctggtaccagcagctgcctggaacagctcctaaactgctcatttatgacaataacaagcgcccatccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 444 - DNA, 671 bp, Artificial sequence
  Synthesized: V1-51, S2A,T5N,P8S,A12G,A13S, P14L, and DNN (aa51-53) changed to GDT
tcacgaattcgcaggccgtcctgaaccagccaagcagcgtctccgggtctctggggcagaaggtgactatcagctgctctggctcatcaagcaacatcgggaataattacgtcagctggtaccagcagctgcctggaacagctcctaaactgctcatttatggcgacacaaagcgcccatccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 445 - DNA, 657 bp, Artificial sequence
  Synthesized: A20J1
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatgagctagc

SEQ ID NO: 446 - DNA, 657 bp, Artificial sequence
  Synthesized: L6J1
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatgagctagc

SEQ ID NO: 447 - DNA, 660 bp, Artificial sequence
  Synthesized: L25J1
gaaatagtgatgacgcagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaatgagctagc

SEQ ID NO: 448 - DNA, 663 bp, Artificial sequence
  Synthesized: V1-2J7
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttcgctgtgttcggaggaggcacccagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 449 - DNA, 663 bp, Artificial sequence
  Synthesized: V1-7J1
cagtctgccctgactcagcctgcctccgtgtctggctcccctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttctatgtcttcggaactgggaccaaggtcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 450 - DNA, 663 bp, Artificial sequence
  Synthesized: V1-11J2
cagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcctgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 451 - DNA, 336 bp, Artificial sequence
  Synthesized: V1-16J6
ccagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcctaatgtgttcggcagtggcaccaaggtgaccgtcctagg

SEQ ID NO: 452 - DNA, 657 bp, Artificial sequence
  Synthesized: V2-17J2
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcaggcatccctgagcgattctctggctccagctcagggacaacagtcacgttgaccatcagtggagtccaggcagaagatgaggctgactattactgtcaatcagcagacagcagtggtacttatcctgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 453 - DNA, 663 bp, Artificial sequence
  Synthesized: V3-4J1
cagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttcttatgtcttcggaactgggaccaaggtcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 454 - DNA, 666 bp, Artificial sequence
  Synthesized: V5-4J2
cagcctgtgctgactcaatcatcctctgcctctgcttccctgggctcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcatgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 455 - DNA, 660 bp, Artificial sequence
  Synthesized: V1-47
caatcagttttgacccagccaccctccgcatccggcacccccgggcaacgcgttacaataagctgtagcggcagctcatctaatattggcagcaactacgtttattggtaccagcagcttccagggaccgcccccaaattgcttatctaccggaataatcagaggccttccggggtgccagataggttctctgggagtaaatctggcactagcgcaagtctggctatcagcgggctccggtctgaggatgaagccgactattattgcgcgagcgctgaggactcatcttctaatgctgtgtttggctccggtaccacactcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 456 - DNA, 660 bp, Artificial sequence
  Synthesized: V1-51
cagtccgtgctgacccaacccccgtcagtgtctgctgcccccgggcagaaggtgactatcagctgctctggctcatcaagcaacatcgggaataattacgtcagctggtaccagcagctgcctggaacagctcctaaactgctcatttatgacaataacaagcgcccatccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagc

SEQ ID NO: 457 - DNA, 4188 bp, Artificial sequence
  Synthesized: vector pFUSE-hIgG2-Fc2
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcgatatcggccatggttagatctgtggagtgcccaccttgcccagcaccacctgtggcaggaccttcagtcttcctcttccccccaaaacccaaggacaccctgatgatctccagaacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 458 - DNA, 4495 bp, Artificial sequence
  Synthesized: vector HC pFuse
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtccagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgcgcaggatgcaactcctgttgctgattgcactaagtcttgcacttgtcacgaattcgccatggctcctcagctagcaccaagggcccatcggtcttccccctggcaccctcctccaagagcacctctgggggcacagcggccctgggctgcctggtcaaggactacttccccgagccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataatctagtggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 459 - DNA, 3822 bp, Artificial sequence
  Synthesized: vector LC-pFuse
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtccagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgcgcaggatgcaactcctgttgctgattgcactaagtcttgcacttgtcacgaattcgccatggccctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataatgagctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 460 - protein, 107 aa, Artificial sequence
  Synthesized: VH4-34+CDR3
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCTSVHQETKKYQS

SEQ ID NO: 461 - protein, 107 aa, Artificial sequence
  Synthesized: VH4-34+CDR3_CDR1 Cow
QVQLQQWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQS

SEQ ID NO: 462 - protein, 107 aa, Artificial sequence
  Synthesized: VH4-34+CDR3_CDR2 Cow
QVQLQQWGAGLLKPSETLSLTCAVYGGSFSGYYWSWIRQPPGKGLEWLGSIDTGGNTGYNPSLKSRVTISVDTSKNQFSLKLSSVTAADTAVYYCTSVHQETKKYQS

SEQ ID NO: 463 - protein, 107 aa, Artificial sequence
  Synthesized: VH4-34+CDR3_CDR1 G31D, Y32K
QVQLQQWGAGLLKPSETLSLTCAVYGGSFSDKYWSWIRQPPGKGLEWIGEINHSGSTNYNPSLKSRVTISVDTSKNQFSLKLSSVTAADTAVYYCTSVHQETKKYQS

SEQ ID NO: 464 - protein, 107 aa, Artificial sequence
  Synthesized: VH4-34+CDR3_CDR2 E50S
QVQLQQWGAGLLKPSETLSLTCAVYGGSFSGYYWSWIRQPPGKGLEWIGSINHSGSTNYNPSLKSRVTISVDTSKNQFSLKLSSVTAADTAVYYCTSVHQETKKYQS

SEQ ID NO: 465 - protein, 107 aa, Artificial sequence
  Synthesized: VH4-34+CDR3_CDR1 Cow_CDR2 Cow
QVQLQQWGAGLLKPSETLSLTCTASGFSLSDKAVGWIRQPPGKGLEWLGSIDTGGNTGYNPSLKSRVTISVDTSKNQFSLKLSSVTAADTAVYYCTSVHQETKKYQS

SEQ ID NO: 466 - protein, 107 aa, Artificial sequence
  Synthesized: VH4-34+CDR3_CDR1 Cow_CDR2 E50S
QVQLQQWGAGLLKPSETLSLTCTASGFSLSDKAVGWIRQPPGKGLEWIGSINHSGSTNYNPSLKSRVTISVDTSKNQFSLKLSSVTAADTAVYYCTSVHQETKKYQS

SEQ ID NO: 467 - protein, 107 aa, Artificial sequence
  Synthesized: VH4-34+CDR3_CDR1 G31D,Y32K_CDR2 Cow
QVQLQQWGAGLLKPSETLSLTCAVYGGSFSDKYWSWIRQPPGKGLEWLGSIDTGGNTGYNPSLKSRVTISVDTSKNQFSLKLSSVTAADTAVYYCTSVHQETKKYQS

SEQ ID NO: 468 - protein, 107 aa, Artificial sequence
  Synthesized: VH4-34+CDR3_CDR1 G31D,Y32K_CDR2 E50S
QVQLQQWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQS

SEQ ID NO: 469 - protein, 25 aa, Artificial sequence
  Synthesized: J region of antibody comprising UL CDR3
SYTYNYEWHVDVWGQGLLVTVSSAS

SEQ ID NO: 470 - protein, 6 aa, Artificial sequence
  Synthesized: VL1-51 CDR2 substituted amino acid resides
DNNKRP

SEQ ID NO: 471 - protein, 6 aa, Artificial sequence
  Synthesized: VL1-51 CDR2 substituted amino acids
GDTSRA

SEQ ID NO: 472 - DNA, 420 bp, Artificial sequence
  Synthesized: HC-pFuse vector with BsaI cassette
caggtgcagctacagcagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcgagacctactatggttcgggtctctcttatacctacaattatgaatggcatgtggatgtctggggacagggcctgctggtgacagtctctagtgctagc

SEQ ID NO: 473 - protein, 133 aa, Artificial sequence
  Synthesized: Hc-pFuse vector with non-bovine sequence insert
  MISC_FEATURE (107)..(107): X is an insert of a non-bovine sequence
  misc_feature (108)..(108): Xaa can be any naturally occurring amino acid
QVQLQQWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQSXSYTYNYEWHVDVWGQGLLVTVSSAS

SEQ ID NO: 474 - DNA, 662 bp, Artificial sequence
  Synthesized: BLV1H12 LV-human lambda LC
tcacgaattcgcaggccgtcctgaaccagccaagcagcgtctccgggtctctggggcagcgggtctcaatcacctgtagcgggtcttcctccaatgtcggcaacggctacgtgtcttggtatcagctgatccctggcagtgccccacgaaccctgatctacggcgacacatccagagcttctggggtccccgatcggttctcagggagcagatccggaaacacagctactctgaccatcagctccctgcaggctgaggacgaagcagattatttctgcgcatctgccgaggactctagttcaaatgccgtgtttggaagcggcaccacactgacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataa

SEQ ID NO: 475 - protein, 74 aa, Artificial sequence
  Synthesized: IL-8 sequence
PRSAKELRCQCIKTYSKPFHPKFIKELRVIESGPHCANTEIIVKLSDGRELCLDPKENWVQRVVEKFLKRAENS

SEQ ID NO: 476 - protein, 25 aa, Artificial sequence
  Synthesized: ziconotide sequence
CKGKGAKCSRLMYDCCTGSCRSGKC

SEQ ID NO: 477 - protein, 15 aa, Artificial sequence
  Synthesized: somatostatin sequence
AGCKNFFWKTFTSCG

SEQ ID NO: 478 - protein, 34 aa, Artificial sequence
  Synthesized: chlorotoxin sequence
MCMPCFTTDHQMARKCDDCCGGKGRGKCYGPQCL

SEQ ID NO: 479 - protein, 68 aa, Artificial sequence
  Synthesized: SDF1(alpha) sequence
KPVSLSYRCPCRFFESHVARANVKHLKILNTPNCALQIVARLKNNNRQVCIDPKLKWIQEYLEKALNK

SEQ ID NO: 480 - protein, 133 aa, Artificial sequence [sequence omitted]

SEQ ID NO: 481 - protein, 30 aa, Artificial sequence
  Synthesized: ProTxII sequence
YCQKWMWTCDSERKCCEGMVCRLWCKKKLW

SEQ ID NO: 482 - protein, 274 aa, Artificial sequence
  Synthesized: Hc BLV1H12
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSCPDGYRERSDCSNRPACGTSDCCRVSVFGNCLTTLPVSYSYTYNYEWHVDVWGQGLLVTVSSASTTAPKVYPLSSCCGDKSSSTVTLGCLVSSYMPEPVTVTWNSGALKSGVHTFPAVLQSSGLYSLSSMVTVPGSTSGQTFTCNVAHPASSTKVDKAVEPKSCDGS

SEQ ID NO: 483 - protein, 216 aa, Artificial sequence
  Synthesized: Lc BLV1H12
QAVLNQPSSVSGSLGQRVSITCSGSSSNVGNGYVSWYQLIPGSAPRTLIYGDTSRASGVPDRFSGSRSGNTATLTISSLQAEDEADYFCASAEDSSSNAVFGSGTTLTVLGQPKSPPSVTLFPPSTEELNGNKATLVCLISDFYPGSVTVVWKADGSTITRNVETTRASKQSNSKYAASSYLSLTSSDWKSKGSYSCEVTHEGSTVTKTVKPSECS

SEQ ID NO: 484 - protein, 269 aa, Artificial sequence
  Synthesized: Hc BLV5B8
QVQLRESGPSLVQPSQTLSLTCTASGFSLSDKAVGWVRQAPGKALEWLGSIDTGGSTGYNPGLKSRLSITKDNSKSQVSLSVSSVTTEDSATYYCTTVHQETRKTCSDGYIAVDSCGRGQSDGCVNDCNSCYYGWRNCRRQPAIHSYEFHVDAWGRGLLVTVSSASTTAPKVYPLSSCCGDKSSSTVTLGCLVSSYMPEPVTVTWNSGALKSGVHTFPAVLQSSGLYSLSSMVTVPGSTSGQTFTCNVAHPASSTKVDKAVEPKSCDGS

SEQ ID NO: 485 - protein, 216 aa, Artificial sequence; identical to SEQ ID NO: 483
  Synthesized: Lc BLV5B8

SEQ ID NO: 486 - DNA, 648 bp, Artificial Sequence
  synthesized: VL-CL of VL1-51 S2A, T5N, P8S, A12G ,A13S, P14L, K46R, L47T, D51G, N52D, N53T
caggccgtcctgaaccagccaagcagcgtctccgggtctctggggcagaaggtgactatcagctgctctggctcatcaagcaacatcgggaataattacgtcagctggtaccagcagctgcctggaacagctcctagaaccctcatttatggcgacacaaagcgcccatccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 487 - DNA, 648 bp, Artificial Sequence
  synthesized: VL-CL of VL1-51 S2A, T5N, P8S, A12G ,A13S, P14L, K46R, L47T,  D51G, N52D, N53T, K54S, P56A
caggccgtcctgaaccagccaagcagcgtctccgggtctctggggcagaaggtgactatcagctgctctggctcatcaagcaacatcgggaataattacgtcagctggtaccagcagctgcctggaacagctcctagaaccctcatttatggcgacacatccagagcttccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 488 - DNA, 648 bp, Artificial Sequence
  synthesized: VL-CL of VL1-51 I29V, N32G, K46R, L47T, D51G, N52D, N53T
cagtccgtgctgacccaacccccgtcagtgtctgctgcccccgggcagaaggtgactatcagctgctctggctcatcctccaatgtcggcaacggctacgtcagctggtaccagcagctgcctggaacagctcctagaaccctcatttatggcgacacaaagcgcccatccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 489 - DNA, 648 bp, Artificial Sequence
  synthesized: VL-CL of VL1-51 I29V, N32G, K46R, L47T, D51G, N52D, N53T, K54S, P56A
cagtccgtgctgacccaacccccgtcagtgtctgctgcccccgggcagaaggtgactatcagctgctctggctcatcctccaatgtcggcaacggctacgtcagctggtaccagcagctgcctggaacagctcctagaaccctcatttatggcgacacatccagagcttccggaatccctgaccgattcagcggaagcaaatcagggacctctgcaactctgggaatcactgggcttcagacaggagatgaggcagattactattgcgcctctgcagaggacagctccagcaatgccgtgttcgggtctggtaccactcttacagtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggaaacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 490 - DNA, 621 bp, Artificial Sequence
  synthesized: VH of VH4-34+CDR3-IL8_Q5RQ6E
caggtgcagctaagagagtggggcgcaggactgttgaagccttcggagacgctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 491 - DNA, 621 bp, Artificial Sequence
  synthesized: VH of VH4-34+CDR3-IL8_CDR1-G31DY32K_Q5RQ6E
caggtgcagctaagagagtggggcgcaggactgttgaagccttcggagacgctgtccctcacctgcgctgtctatggtgggtccttcagtgacaagtactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 492 - DNA, 621 bp, Artificial Sequence
  synthesized: VH of VH4-34+CDR3-IL8_CDR2-E50S_Q5RQ6E
caggtgcagctaagagagtggggcgcaggactgttgaagccttcggagacgctgtccctcacctgcgctgtctatggtgggtccttcagtggttactactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 493 - DNA, 621 bp, Artificial Sequence
  synthesized: VH of VH4-34+CDR3-IL8_CDR1-G31DY32K_CDR2-E50S_Q5RQ6E
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 494 - DNA, 621 bp, Artificial Sequence
  synthesized: VH of VH4-34+CDR3-IL8_CDR1-Cow_Q5RQ6E
caggtgcagctaagagagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 495 - DNA, 621 bp, Artificial Sequence
  synthesized: VH of VH4-34+CDR3-IL8_CDR2-Cow_Q5RQ6E
caggtgcagctaagagagtggggcgcaggactgttgaagccttcggagacgctgtccctcacctgcgctgtctatggtgggctgggcagcatcgataccggcgggaacacagggtccttcagtggttactactggagctggattcgccagcccccagggaaggggctggagtggtacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 496 - DNA, 621 bp, Artificial Sequence
  synthesized: VH of VH4-34+CDR3-IL8_CDR1-Cow_CDR2-E50S_Q5RQ6E
caggtgcagctaagagagtggggcgcaggactgttgaagccttcggagacgctgtccctcacctgcacagcaagcgggttttcactgagcgacaaggcagtgggatggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 497 - DNA, 621 bp, Artificial Sequence
  synthesized: VH of VH4-34+CDR3-IL8_CDR1-Cow_CDR2-Cow_Q5RQ6E
caggtgcagctaagagagtggggcgcaggactgttgaagccttcggagacgctgtccctcacctgcacagcaagcgggttttcactgagcgacaaggcagtgggatggattcgccagcccccagggaaggggctggagtggctgggcagcatcgataccggcgggaacacagggtacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagt

SEQ ID NO: 498 - protein, 12 aa, Artificial Sequence
  synthesized: Heavy Chain CDR3 Ascending Stalk
TSVHQETKKYQS

SEQ ID NO: 499 - protein, 12 aa, Artificial Sequence
  synthesized: Heavy Chain CDR3 Descending Stalk
SYTYNYEWHVDV

SEQ ID NO: 500 - protein, 11 aa, Artificial Sequence
  synthesized: BLV1H12 Heavy Chain J region outside of CDR3
WGQGLLVTVSS

SEQ ID NO: 501 - protein, 14 aa, Artificial Sequence
  synthesized: A region of antibody PGT145
GSKHRLRDYFLYNE

SEQ ID NO: 502 - protein, 13 aa, Artificial Sequence
  synthesized: A region of antibody PGT145
GSKHRLRDYFLYN

SEQ ID NO: 503 - protein, 12 aa, Artificial Sequence
  synthesized: A region of antibody PGT145
GSKHRLRDYFLY

SEQ ID NO: 504 - protein, 11 aa, Artificial Sequence
  synthesized: A region of antibody PGT145
GSKHRLRDYFL

SEQ ID NO: 505 - protein, 10 aa, Artificial Sequence
  synthesized: A region of antibody PGT145
GSKHRLRDYF

SEQ ID NO: 506 - protein, 9 aa, Artificial Sequence
  synthesized: A region of antibody PGT145
GSKHRLRDY

SEQ ID NO: 507 - protein, 8 aa, Artificial Sequence
  synthesized: A region of antibody PGT145
GSKHRLRD

SEQ ID NO: 508 - protein, 13 aa, Artificial Sequence
  synthesized: A region of antibody PG9
EAGGPDYRNGYNY

SEQ ID NO: 509 - protein, 12 aa, Artificial Sequence
  synthesized: A region of antibody PG9
EAGGPDYRNGYN

SEQ ID NO: 510 - protein, 11 aa, Artificial Sequence
  synthesized: A region of antibody PG9
EAGGPDYRNGY

SEQ ID NO: 511 - protein, 10 aa, Artificial Sequence
  synthesized: A region of antibody PG9
EAGGPDYRNG

SEQ ID NO: 512 - protein, 9 aa, Artificial Sequence
  synthesized: A region of antibody PG9
EAGGPDYRN

SEQ ID NO: 513 - protein, 8 aa, Artificial Sequence
  synthesized: A region of antibody PG9
EAGGPDYR

SEQ ID NO: 514 - protein, 7 aa, Artificial Sequence
  synthesized: A region of antibody PG9
EAGGPDY

SEQ ID NO: 515 - protein, 6 aa, Artificial Sequence
  synthesized: A region of antibody PG9
EAGGPD

SEQ ID NO: 516 - protein, 13 aa, Artificial Sequence
  synthesized: A region of antibody PG16
EAGGPIWHDDVKY

SEQ ID NO: 517 - protein, 12 aa, Artificial Sequence
  synthesized: A region of antibody PG16
EAGGPIWHDDVK

SEQ ID NO: 518 - protein, 11 aa, Artificial Sequence
  synthesized: A region of antibody PG16
EAGGPIWHDDV

SEQ ID NO: 519 - protein, 10 aa, Artificial Sequence
  synthesized: A region of antibody PG16
EAGGPIWHDD

SEQ ID NO: 520 - protein, 9 aa, Artificial Sequence
  synthesized: A region of antibody PG16
EAGGPIWHD

SEQ ID NO: 521 - protein, 8 aa, Artificial Sequence
  synthesized: A region of antibody PG16
EAGGPIWH

SEQ ID NO: 522 - protein, 7 aa, Artificial Sequence
  synthesized: A region of antibody PG16
EAGGPIW

SEQ ID NO: 523 - protein, 6 aa, Artificial Sequence
  synthesized: A region of antibody PG16
EAGGPI

SEQ ID NO: 524 - protein, 11 aa, Artificial Sequence
  synthesized: A region of antibody CHO4
GTDYTIDDQGI

SEQ ID NO: 525 - protein, 10 aa, Artificial Sequence
  synthesized: A region of antibody CHO4
GTDYTIDDQG

SEQ ID NO: 526 - protein, 9 aa, Artificial Sequence
  synthesized: A region of antibody CHO4
GTDYTIDDQ

SEQ ID NO: 527 - protein, 8 aa, Artificial Sequence
  synthesized: A region of antibody CHO4
GTDYTIDD

SEQ ID NO: 528 - protein, 7 aa, Artificial Sequence
  synthesized: A region of antibody CHO4
GTDYTID

SEQ ID NO: 529 - protein, 6 aa, Artificial Sequence
  synthesized: A region of antibody CHO4
GTDYTI

SEQ ID NO: 530 - protein, 11 aa, Artificial Sequence
  synthesized: A region of antibody 2909
DKGDSDYDYNL

SEQ ID NO: 531 - protein, 10 aa, Artificial Sequence
  synthesized: A region of antibody 2909
DKGDSDYDYN

SEQ ID NO: 532 - protein, 9 aa, Artificial Sequence
  synthesized: A region of antibody 2909
DKGDSDYDY

SEQ ID NO: 533 - protein, 8 aa, Artificial Sequence
  synthesized: A region of antibody 2909
DKGDSDYD

SEQ ID NO: 534 - protein, 7 aa, Artificial Sequence
  synthesized: A region of antibody 2909
DKGDSDY

SEQ ID NO: 535 - protein, 6 aa, Artificial Sequence
  synthesized: A region of antibody 2909
DKGDSD

SEQ ID NO: 536 - protein, 17 aa, Artificial Sequence
  synthesized: D region of antibody PGT145
YGPNYEEWGDYLATLDV

SEQ ID NO: 537 - protein, 16 aa, Artificial Sequence
  synthesized: D region of antibody PGT145
GPNYEEWGDYLATLDV

SEQ ID NO: 538 - protein, 15 aa, Artificial Sequence
  synthesized: D region of antibody PGT145
PNYEEWGDYLATLDV

SEQ ID NO: 539 - protein, 14 aa, Artificial Sequence
  synthesized: D region of antibody PGT145
NYEEWGDYLATLDV

SEQ ID NO: 540 - protein, 13 aa, Artificial Sequence
  synthesized: D region of antibody PGT145
YEEWGDYLATLDV

SEQ ID NO: 541 - protein, 12 aa, Artificial Sequence
  synthesized: D region of antibody PGT145
EEWGDYLATLDV

SEQ ID NO: 542 - protein, 15 aa, Artificial Sequence
  synthesized: D region of antibody PG9
YDFYDGYYNYHYMDV

SEQ ID NO: 543 - protein, 14 aa, Artificial Sequence
  synthesized: D region of antibody PG9
DFYDGYYNYHYMDV

SEQ ID NO: 544 - protein, 13 aa, Artificial Sequence
  synthesized: D region of antibody PG9
FYDGYYNYHYMDV

SEQ ID NO: 545 - protein, 12 aa, Artificial Sequence
  synthesized: D region of antibody PG9
YDGYYNYHYMDV

SEQ ID NO: 546 - protein, 11 aa, Artificial Sequence
  synthesized: D region of antibody PG9
DGYYNYHYMDV

SEQ ID NO: 547 - protein, 10 aa, Artificial Sequence
  synthesized: D region of antibody PG9
GYYNYHYMDV

SEQ ID NO: 548 - protein, 9 aa, Artificial Sequence
  synthesized: D region of antibody PG9
YYNYHYMDV

SEQ ID NO: 549 - protein, 15 aa, Artificial Sequence
  synthesized: D region of antibody PG16
YDFNDGYYNYHYMDV

SEQ ID NO: 550 - protein, 14 aa, Artificial Sequence
  synthesized: D region of antibody PG16
DFYDGYYNYHYMDV

SEQ ID NO: 551 - protein, 13 aa, Artificial Sequence
  synthesized: D region of antibody PG16
FYDGYYNYHYMDV

SEQ ID NO: 552 - protein, 12 aa, Artificial Sequence
  synthesized: D region of antibody PG16
YDGYYNYHYMDV

SEQ ID NO: 553 - protein, 11 aa, Artificial Sequence
  synthesized: D region of antibody PG16
DGYYNYHYMDV

SEQ ID NO: 554 - protein, 10 aa, Artificial Sequence
  synthesized: D region of antibody PG16
GYYNYHYMDV

SEQ ID NO: 555 - protein, 16 aa, Artificial Sequence
  synthesized: D region of antibody CHO4
QGIRYQGSGTFWYFDV

SEQ ID NO: 556 - protein, 15 aa, Artificial Sequence
  synthesized: D region of antibody CHO4
GIRYQGSGTFWYFDV

SEQ ID NO: 557 - protein, 14 aa, Artificial Sequence
  synthesized: D region of antibody CHO4
IRYQGSGTFWYFDV

SEQ ID NO: 558 - protein, 13 aa, Artificial Sequence
  synthesized: D region of antibody CHO4
RYQGSGTFWYFDV

SEQ ID NO: 559 - protein, 12 aa, Artificial Sequence
  synthesized: D region of antibody CHO4
YQGSGTFWYFDV

SEQ ID NO: 560 - protein, 11 aa, Artificial Sequence
  synthesized: D region of antibody CHO4
QGSGTFWYFDV

SEQ ID NO: 561 - protein, 10 aa, Artificial Sequence
  synthesized: D region of antibody CHO4
GSGTFWYFDV

SEQ ID NO: 562 - protein, 9 aa, Artificial Sequence
  synthesized: D region of antibody CHO4
SGTFWYFDV

SEQ ID NO: 563 - protein, 8 aa, Artificial Sequence
  synthesized: D region of antibody CHO4
GTFWYFDV

SEQ ID NO: 564 - protein, 13 aa, Artificial Sequence
  synthesized: D region of antibody 2909
YNLGYSYFYYMDG

SEQ ID NO: 565 - protein, 12 aa, Artificial Sequence
  synthesized: D region of antibody 2909
NLGYSYFYYMDG

SEQ ID NO: 566 - protein, 11 aa, Artificial Sequence
  synthesized: D region of antibody 2909
LGYSYFYYMDG

SEQ ID NO: 567 - protein, 10 aa, Artificial Sequence
  synthesized: D region of antibody 2909
GYSYFYYMDG

SEQ ID NO: 568 - protein, 9 aa, Artificial Sequence
  synthesized: D region of antibody 2909
YSYFYYMDG

SEQ ID NO: 569 - protein, 8 aa, Artificial Sequence
  synthesized: D region of antibody 2909
SYFYYMDG

SEQ ID NO: 570 - protein, 11 aa, Artificial Sequence
  synthesized: V2 region of antibody PGT145
WGHGTAVTVSS

SEQ ID NO: 571 - protein, 11 aa, Artificial Sequence
  synthesized: V2 region of antibody PG9
WGKGTTVTVSS

SEQ ID NO: 572 - protein, 11 aa, Artificial Sequence
  synthesized: V2 region of antibody PG16
WGKGTTVTVSS

SEQ ID NO: 573 - protein, 11 aa, Artificial Sequence
  synthesized: V2 region of antibody CHO4
WGRGTLVTVSS

SEQ ID NO: 574 - protein, 11 aa, Artificial Sequence
  synthesized: V2 region of antibody 2909
WGKGTTVTVSS

SEQ ID NO: 575 - protein, 5 aa, Artificial Sequence
  synthesized: linker sequence
GGGGS

SEQ ID NO: 576 - protein, 10 aa, Artificial Sequence
  synthesized: linker sequence
GGGGSGGGGS

SEQ ID NO: 577 - protein, 15 aa, Artificial Sequence
  synthesized: linker sequence
GGGGSGGGGSGGGGS

SEQ ID NO: 578 - protein, 20 aa, Artificial Sequence
  synthesized: linker sequence
GGGGSGGGGSGGGGSGGGGS

SEQ ID NO: 579 - protein, 3 aa, Artificial Sequence
  synthesized: linker sequence
GGS

SEQ ID NO: 580 - protein, 6 aa, Artificial Sequence
  synthesized: linker sequence
GGSGGS

SEQ ID NO: 581 - protein, 9 aa, Artificial Sequence
  synthesized: linker sequence
GGSGGSGGS

SEQ ID NO: 582 - protein, 12 aa, Artificial Sequence
  synthesized: linker sequence
GGSGGSGGSGGS

SEQ ID NO: 583 - protein, 3 aa, Artificial Sequence
  synthesized: linker sequence
ASG

SEQ ID NO: 584 - protein, 6 aa, Artificial Sequence
  synthesized: linker sequence
ASGASG

SEQ ID NO: 585 - protein, 9 aa, Artificial Sequence
  synthesized: linker sequence
ASGASGASG

SEQ ID NO: 586 - protein, 12 aa, Artificial Sequence
  synthesized: linker sequence
ASGASGASGASG

SEQ ID NO: 587 - protein, 7 aa, Artificial Sequence
  synthesized: linker sequence
GCGGGGS

SEQ ID NO: 588 - protein, 12 aa, Artificial Sequence
  synthesized: linker sequence
GCGGGGSGGGGS

SEQ ID NO: 589 - protein, 17 aa, Artificial Sequence
  synthesized: linker sequence
GCGGGGSGGGGSGGGGS

SEQ ID NO: 590 - protein, 22 aa, Artificial Sequence
  synthesized: linker sequence
GCGGGGSGGGGSGGGGSGGGGS

SEQ ID NO: 591 - protein, 5 aa, Artificial Sequence
  synthesized: linker sequence
GCGGS

SEQ ID NO: 592 - protein, 8 aa, Artificial Sequence
  synthesized: linker sequence
GCGGSGGS

SEQ ID NO: 593 - protein, 11 aa, Artificial Sequence
  synthesized: linker sequence
GCGGSGGSGGS

SEQ ID NO: 594 - protein, 14 aa, Artificial Sequence
  synthesized: linker sequence
GCGGSGGSGGSGGS

SEQ ID NO: 595 - protein, 5 aa, Artificial Sequence
  synthesized: linker sequence
GCASG

SEQ ID NO: 596 - protein, 10 aa, Artificial Sequence
  synthesized: linker sequence
GCGCASGASG

SEQ ID NO: 597 - protein, 11 aa, Artificial Sequence
  synthesized: linker sequence
GCASGASGASG

SEQ ID NO: 598 - protein, 14 aa, Artificial Sequence
  synthesized: linker sequence
GCASGASGASGASG

SEQ ID NO: 599 - protein, 37 aa, Artificial Sequence
  synthesized: ADWX-1
VGINVKCKHSRQCLKPCKDAGMRFGKCTNGKCHCTPK

SEQ ID NO: 600 - protein, 34 aa, Artificial Sequence
  synthesized: HsTx1
ASCRTPKDCADPCRKETGCPYGKCMNRKCKCNRC

SEQ ID NO: 601 - protein, 38 aa, Artificial Sequence
  synthesized: OSK1
GVIINVKCKISRQCLEPCKKAGMRFGKCMNGKCHCTPK

SEQ ID NO: 602 - protein, 35 aa, Artificial Sequence
  synthesized: Pi2
TISCTNPKQCYPHCKKETGYPNAKCMNRKCKCFGR

SEQ ID NO: 603 - protein, 39 aa, Artificial Sequence
  synthesized: Hongotoxin (HgTX)
TVIDVKCTSPKQCLPPCKAQFGIRAGAKCMNGKCKCYPH

SEQ ID NO: 604 - protein, 39 aa, Artificial Sequence
  synthesized: Margatoxin
TIINVKCTSPKQCLPPCKAQFGQSAGAKCMNGKCKCYPH

SEQ ID NO: 605 - protein, 38 aa, Artificial Sequence
  synthesized: Agitoxin-2
GVPINVSCTGSPQCIKPCKDAGMRFGKCMNRKCHCTPK

SEQ ID NO: 606 - protein, 35 aa, Artificial Sequence
  synthesized: Pi3
TISCTNEKQCYPHCKKETGYPNAKCMNRKCKCFGR

SEQ ID NO: 607 - protein, 38 aa, Artificial Sequence
  synthesized: Kaliotoxin
GVEINVKCSGSPQCLKPCKDAGMRFGKCMNRKCHCTPK

SEQ ID NO: 608 - protein, 35 aa, Artificial Sequence
  synthesized: Anuroctoxin
ZKECTGPQHCTNFCRKNKCTHGKCMNRKCKCFNCK

SEQ ID NO: 609 - protein, 37 aa, Artificial Sequence
  synthesized: Charybdotoxin
ZFTNVSCTTSKECWSVCQRLHNTSRGKCMNKKCRCYS

SEQ ID NO: 610 - protein, 37 aa, Artificial Sequence
  synthesized: Tityustoxin -K- alpha
VFINAKCRGSPECLPKCKEAIGKAAGKCMNGKCKCYP

SEQ ID NO: 611 - protein, 34 aa, Artificial Sequence
  synthesized: Maurotoxin
VSCTGSKDCYAPCRKQTGCPNAKCINKSCKCYGC

SEQ ID NO: 612 - protein, 33 aa, Artificial Sequence
  synthesized: Ceratotoxin 1 (CcoTx1)
DCLGWFKSCDPKNDKCCKNYTCSRRDRWCKYDL

SEQ ID NO: 613 - protein, 33 aa, Artificial Sequence
  synthesized: CcoTx2
DCLGWFKSCDPKNDKCCKNYTCSRRDRWCKYYL

SEQ ID NO: 614 - protein, 39 aa, Artificial Sequence
  synthesized: CcoTx3
GVDKEGCRKLLGGCTIDDDCCPHLGCNKKYWHCGWDGTF

SEQ ID NO: 615 - protein, 34 aa, Artificial Sequence
  synthesized: Phrixotoxin 3 (PaurTx3)
DCLGFLWKCNPSNDKCCRPNLVCSRKDKWCKYQI

SEQ ID NO: 616 - protein, 35 aa, Artificial Sequence
  synthesized: Hanatoxin 1
ECRYLFGGCKTTSDCCKHLGCKFRDKYCAWDFTFS

SEQ ID NO: 617 - protein, 29 aa, Artificial Sequence
  synthesized: Phrixotoxin 1
YCQKWMWTCDSARKCCEGLVCRLWCKKII

SEQ ID NO: 618 - protein, 35 aa, Artificial Sequence
  synthesized: Huwentoxin-IV
ECLEIFKACNPSNDQCCKSSKLVCSRKTRWCKYQI

SEQ ID NO: 619 - protein, 12 aa, Artificial Sequence
  synthesized: alpha-conotoxin ImI
GCCSDPRCAWRC

SEQ ID NO: 620 - protein, 16 aa, Artificial Sequence
  synthesized: alpha-conotoxin EpI
GCCSDPRCNMNNPDYC

SEQ ID NO: 621 - protein, 16 aa, Artificial Sequence
  synthesized: alpha-conotoxin PnIA
GCCSLPPCAANNPDYC

SEQ ID NO: 622 - protein, 16 aa, Artificial Sequence
  synthesized: alpha-conotoxin PnIB
GCCSLPPCALSNPDYC

SEQ ID NO: 623 - protein, 16 aa, Artificial Sequence
  synthesized: alpha-conotoxin MII
GCCSNPVCHLEHSNLC

SEQ ID NO: 624 - protein, 16 aa, Artificial Sequence
  synthesized: alpha-conotoxin AuIA
GCCSYPPCFATNSDYC

SEQ ID NO: 625 - protein, 15 aa, Artificial Sequence
  synthesized: alpha-conotoxin AuIB
GCCSYPPCFATNPDC

SEQ ID NO: 626 - protein, 16 aa, Artificial Sequence
  synthesized: alpha-conotoxin AuIC
GCCSYPPCFATNSGYC

SEQ ID NO: 627 - protein, 27 aa, Artificial Sequence
  synthesized: conotoxin kappa-PVIIA
CRIPNQKCFQHLDDCCSRKCNRFNKCV

SEQ ID NO: 628 - protein, 37 aa, Artificial Sequence; identical to SEQ ID NO: 609
  synthesized: charybdotoxin

SEQ ID NO: 629 - protein, 55 aa, Artificial Sequence
  synthesized: neurotoxin B-IV
ASATWGAAYPACENNCRKKYDLCIRCQGKWAGKRGKCAAHCIIQKNNCKGKCKKE

SEQ ID NO: 630 - protein, 43 aa, Artificial Sequence
  synthesized: crotamine
YKQCHKKGGHCFPKEKICLPPSSDFGKMDCCRWRWKCCKKGSG

SEQ ID NO: 631 - protein, 27 aa, Artificial Sequence
  synthesized: omega-GVIA (conotoxin)
CKSPGSSCSPTSYNCCRSCNPYTKRCY

SEQ ID NO: 632 - protein, 22 aa, Artificial Sequence
  synthesized: kappa-hefutoxin 1
GHACYRNCWREGNDEETCKERC

SEQ ID NO: 633 - protein, 66 aa, Artificial Sequence
  synthesized: Css4
KEGYLVNSYTGCKFECFKLGDNDYCLRECRQQYGKGSGGYCYAFGCWCTHLYEQAVVWPLPNKTCN

SEQ ID NO: 634 - protein, 76 aa, Artificial Sequence
  synthesized: Bj-xtrIT
KKNGYPLDRNGKTTECSGVNAIAPHYCNSECTKVYVAESGYCCWGACYCFGLEDDKPIGPMKDITKKYCDVQIIPS

SEQ ID NO: 635 - protein, 41 aa, Artificial Sequence
  synthesized: BcIV
GLPCDCHGHTGTYWLNYYSKCPKGYGYTGRCRYLVGSCCYK

SEQ ID NO: 636 - protein, 37 aa, Artificial Sequence
  synthesized: Hm-1
GCIPYGKTCEFWSGPWCCAGKCKLNVWSMTLSCTRNF

SEQ ID NO: 637 - protein, 40 aa, Artificial Sequence
  synthesized: Hm-2
GCIPSFGECAWFSGESCCTGICKWVFFTSKFMCRRVWGKD

SEQ ID NO: 638 - protein, 29 aa, Artificial Sequence
  synthesized: GsAF-I(beta-theraphotoxin-Gr1b)
YCQKWLWTCDSERKCCEDMVCRLWCKKRL

SEQ ID NO: 639 - protein, 35 aa, Artificial Sequence
  synthesized: Protoxin I (ProTx-I, beta-theraphotoxin-Tp1-alpha)
ECRYWLGGCSAGQTCCKHLVCSRRHGWCVWDGTFS

SEQ ID NO: 640 - protein, 30 aa, Artificial Sequence; identical to SEQ ID NO: 481
  synthesized: Protoxin II (ProTx II)

SEQ ID NO: 641 - protein, 33 aa, Artificial Sequence
  synthesized: Huwentoxin I
ACKGVFDACTPGKNECCPNRVCSDKHKWCKWKL

SEQ ID NO: 642 - protein, 22 aa, Artificial Sequence
  synthesized: mu-Conotoxin PIIIA
ERLCCGFPKSCRSRQCKPHRCC

SEQ ID NO: 643 - protein, 36 aa, Artificial Sequence
  synthesized: Jingzhaotoxin-III(beta-TRTX-Cj1-alpha)
DGECGGFWWKCGRGKPPCCKGYACSKTWGWCAVEAP

SEQ ID NO: 644 - protein, 31 aa, Artificial Sequence
  synthesized: GsAF-II (Kappa-theraphotoxin-Gr2c)
YCQKWMWTCDEERKCCEGLVCRLWCKKKIEW

SEQ ID NO: 645 - protein, 35 aa, Artificial Sequence
  synthesized: ShK, K16,E30
RSCIDTIPKSRCTAFKCKHSMKYRLSFCRETCGTC

SEQ ID NO: 646 - protein, 35 aa, Artificial Sequence
  synthesized: ShK (Stichodactyla toxin)
RSCIDTIPKSRCTAFQCKHSMKYRLSFCRKTCGTC

SEQ ID NO: 647 - protein, 34 aa, Artificial Sequence; identical to SEQ ID NO: 600
  synthesized: HsTx1

SEQ ID NO: 648 - protein, 36 aa, Artificial Sequence
  synthesized: Guangxitoxin 1E, GxTx-1E
EGECGGFWWKCGSGKPACCPKYVCSPKWGLCNFPMP

SEQ ID NO: 649 - protein, 37 aa, Artificial Sequence
  synthesized: Charybdotoxin, ChTX
EFTNVSCTTSKECWSVCQRLHNTSRGKCMNKKCRCYS

SEQ ID NO: 650 - protein, 37 aa, Artificial Sequence
  synthesized: Iberiotoxin, IbTx
EFTDVDCSVSKECWSVCKDLFGVDRGKCMGKKCRCYQ

SEQ ID NO: 651 - protein, 31 aa, Artificial Sequence
  synthesized: Leiurotoxin 1, scyllatoxin
AFCNLRMCQLSCRSLGLLGKCIGDKCECVKH

SEQ ID NO: 652 - protein, 31 aa, Artificial Sequence
  synthesized: Tamapin
AFCNLRRCELSCRSLGLLGKCIGEECKCVPY

SEQ ID NO: 653 - protein, 38 aa, Artificial Sequence; identical to SEQ ID NO: 607
  synthesized: Kaliotoxin-1, KTX

SEQ ID NO: 654 - protein, 35 aa, Artificial Sequence
  synthesized: Purotoxin1, PT-1
GYCAEKGIRCDDIHCCTGLKCKCNASGYNCVCRKK

SEQ ID NO: 655 - protein, 34 aa, Artificial Sequence
  synthesized: GpTx-1
DCLGFMRKCIPDNDKCCRPNLVCSRTHKWCKYVF

SEQ ID NO: 656-665 - skipped (10 entries)

SEQ ID NO: 666 - protein, 11 aa, Artificial Sequence
  synthesized: Block-1 sequence of ADWX-1
VGINVKCKHSR

SEQ ID NO: 667 - protein, 7 aa, Artificial Sequence
  synthesized: Block-1 sequence of HsTx1
ASCRTPK

SEQ ID NO: 668 - protein, 12 aa, Artificial Sequence
  synthesized: Block-1 sequence of OSK1
GVIINVKCKISR

SEQ ID NO: 669 - protein, 8 aa, Artificial Sequence
  synthesized: Block-1 sequence of Pi2
TISCTNPK

SEQ ID NO: 670 - protein, 11 aa, Artificial Sequence
  synthesized: Block-1 sequence of Hongotoxin (HgTX)
TVIDVKCTSPK

SEQ ID NO: 671 - protein, 11 aa, Artificial Sequence
  synthesized: Block-1 sequence of Margatoxin
TIINVKCTSPK

SEQ ID NO: 672 - protein, 12 aa, Artificial Sequence
  synthesized: Block-1 sequence of Agitoxin-2
GVPINVSCTGSP

SEQ ID NO: 673 - protein, 8 aa, Artificial Sequence
  synthesized: Block-1 sequence of Pi3
TISCTNEK

SEQ ID NO: 674 - protein, 12 aa, Artificial Sequence
  synthesized: Block-1 sequence of Kaliotoxin
GVEINVKCSGSP

SEQ ID NO: 675 - protein, 8 aa, Artificial Sequence
  synthesized: Block-1 sequence of Anuroctoxin
ZKECTGPQ

SEQ ID NO: 676 - protein, 11 aa, Artificial Sequence
  synthesized: Block-1 sequence of Charybdotoxin
ZFTNVSCTTSK

SEQ ID NO: 677 - protein, 12 aa, Artificial Sequence
  synthesized: Block-2 sequence of ADWX-1
LKPCKDAGMRFG

SEQ ID NO: 678 - protein, 13 aa, Artificial Sequence
  synthesized: Block-2 sequence of HsTx1
ADPCRKETGCPYG

SEQ ID NO: 679 - protein, 12 aa, Artificial Sequence
  synthesized: Block-2 sequence of OSK1
LEPCKKAGMRFG

SEQ ID NO: 680 - protein, 13 aa, Artificial Sequence
  synthesized: Block-2 sequence of Pi2
YPHCKKETGYPNA

SEQ ID NO: 681 - protein, 14 aa, Artificial Sequence
  synthesized: Block-2 sequence of Hongotoxin (HgTX)
LPPCKAQFGIRAGA

SEQ ID NO: 682 - protein, 14 aa, Artificial Sequence
  synthesized: Block-2 sequence of Margatoxin
LPPCKAQFGQSAGA

SEQ ID NO: 683 - protein, 12 aa, Artificial Sequence
  synthesized: Block-2 sequence of Agitoxin-2
IKPCKDAGMRFG

SEQ ID NO: 684 - protein, 13 aa, Artificial Sequence
  synthesized: Block-2 sequence of Pi3
YPHCKKETGYPNA

SEQ ID NO: 685 - protein, 12 aa, Artificial Sequence
  synthesized: Block-2 sequence of Kaliotoxin
LKPCKDAGMRFG

SEQ ID NO: 686 - protein, 12 aa, Artificial Sequence
  synthesized: Block-2 sequence of Anuroctoxin
TNFCRKNKCTHG

SEQ ID NO: 687 - protein, 13 aa, Artificial Sequence
  synthesized: Block-2 sequence of Charybdotoxin
WSVCQRLHNTSRG

SEQ ID NO: 688 - protein, 9 aa, Artificial Sequence
  synthesized: Block-3 sequence of ADWX-1
NGKCHCTPK

SEQ ID NO: 689 - protein, 9 aa, Artificial Sequence
  synthesized: Block-3 sequence of HsTx1
NRKCKCNRC

SEQ ID NO: 690 - protein, 9 aa, Artificial Sequence
  synthesized: Block-3 sequence of OSK1
NGKCHCTPK

SEQ ID NO: 691 - protein, 9 aa, Artificial Sequence
  synthesized: Block-3 sequence of Pi2
NRKCKCFGR

SEQ ID NO: 692 - protein, 9 aa, Artificial Sequence
  synthesized: Block-3 sequence of Hongotoxin (HgTX)
NGKCKCYPH

SEQ ID NO: 693 - protein, 9 aa, Artificial Sequence
  synthesized: Block-3 sequence of Margatoxin
NGKCKCYPH

SEQ ID NO: 694 - protein, 9 aa, Artificial Sequence
  synthesized: Block-3 sequence of Agitoxin-2
NRKCHCTPK

SEQ ID NO: 695 - protein, 9 aa, Artificial Sequence
  synthesized: Block-3 sequence of Pi3
NRKCKCFGR

SEQ ID NO: 696 - protein, 9 aa, Artificial Sequence
  synthesized: Block-3 sequence of Kaliotoxin
NRKCHCTPK

SEQ ID NO: 697 - protein, 10 aa, Artificial Sequence
  synthesized: Block-3 sequence of Anuroctoxin
NRKCKCFNCK

SEQ ID NO: 698 - protein, 8 aa, Artificial Sequence
  synthesized: Block-3 sequence of Charybdotoxin
NKKCRCYS

SEQ ID NO: 699 - protein, 5 aa, Artificial Sequence
  synthesized: linker sequence
SGGGG

SEQ ID NO: 700 - protein, 10 aa, Artificial Sequence
  synthesized: linker sequence
SGGGGSGGGG

SEQ ID NO: 701 - protein, 15 aa, Artificial Sequence
  synthesized: linker sequence
SGGGGSGGGGSGGGG

SEQ ID NO: 702 - protein, 20 aa, Artificial Sequence
  synthesized: linker sequence
SGGGGSGGGGSGGGGSGGGG

SEQ ID NO: 703 - protein, 3 aa, Artificial Sequence
  synthesized: linker sequence
SGG

SEQ ID NO: 704 - protein, 6 aa, Artificial Sequence
  synthesized: linker sequence
SGGSGG

SEQ ID NO: 705 - protein, 9 aa, Artificial Sequence
  synthesized: linker sequence
SGGSGGSGG

SEQ ID NO: 706 - protein, 12 aa, Artificial Sequence
  synthesized: linker sequence
SGGSGGSGGSGG

SEQ ID NO: 707 - protein, 3 aa, Artificial Sequence
  synthesized: linker sequence
GSA

SEQ ID NO: 708 - protein, 6 aa, Artificial Sequence
  synthesized: linker sequence
GSAGSA

SEQ ID NO: 709 - protein, 9 aa, Artificial Sequence
  synthesized: linker sequence
GSAGSAGSA

SEQ ID NO: 710 - protein, 12 aa, Artificial Sequence
  synthesized: linker sequence
GSAGSAGSAGSA

SEQ ID NO: 711 - protein, 7 aa, Artificial Sequence
  synthesized: linker sequence
SGGGGCG

SEQ ID NO: 712 - protein, 12 aa, Artificial Sequence
  synthesized: linker sequence
SGGGGSGGGGCG

SEQ ID NO: 713 - protein, 17 aa, Artificial Sequence
  synthesized: linker sequence
SGGGGSGGGGSGGGGCG

SEQ ID NO: 714 - protein, 22 aa, Artificial Sequence
  synthesized: linker sequence
SGGGGSGGGGSGGGGSGGGGCG

SEQ ID NO: 715 - protein, 5 aa, Artificial Sequence
  synthesized: linker sequence
SGGCG

SEQ ID NO: 716 - protein, 8 aa, Artificial Sequence
  synthesized: linker sequence
SGGSGGCG

SEQ ID NO: 717 - protein, 11 aa, Artificial Sequence
  synthesized: linker sequence
SGGSGGSGGCG

SEQ ID NO: 718 - protein, 14 aa, Artificial Sequence
  synthesized: linker sequence
SGGSGGSGGSGGCG

SEQ ID NO: 719 - protein, 5 aa, Artificial Sequence
  synthesized: linker sequence
GSACG

SEQ ID NO: 720 - protein, 10 aa, Artificial Sequence
  synthesized: linker sequence
GSAGSACGCG

SEQ ID NO: 721 - protein, 11 aa, Artificial Sequence
  synthesized: linker sequence
GSAGSAGSACG

SEQ ID NO: 722 - protein, 14 aa, Artificial Sequence
  synthesized: linker sequence
GSAGSAGSAGSACG

SEQ ID NO: 723 - protein, 7 aa, Artificial Sequence
  synthesized: linker sequence
GGGGSGG

SEQ ID NO: 724 - protein, 17 aa, Artificial Sequence
  synthesized: linker sequence
GGGGSGGGGSGGGGSGG

SEQ ID NO: 725 - protein, 7 aa, Artificial Sequence
  synthesized: linker sequence
GGSGGGG

SEQ ID NO: 726 - protein, 17 aa, Artificial Sequence
  synthesized: linker sequence
GGSGGGGSGGGGGGGGS

SEQ ID NO: 727 - protein, 34 aa, Artificial Sequence
  synthesized: MOKA Toxin
INVKCSLPQQCIKPCKDAGMRFGKCMNKKCRCYS

SEQ ID NO: 728 - protein, 38 aa, Artificial Sequence
  synthesized: OSK1, P12, K16, D20
GVIINVKCKISPQCLKPCKDAGMRFGKCMNGKCHCTPK

SEQ ID NO: 729 - protein, 38 aa, Artificial Sequence
  synthesized: OSK1 K16, D20
GVIINVKCKISRQCLKPCKDAGMRFGKCMNGKCHCTPK

SEQ ID NO: 730 - protein, 35 aa, Artificial Sequence
  synthesized: HmK
RTCKDLIPVSECTDIRCRTSMKYRLNLCRKTCGSC

SEQ ID NO: 731 - protein, 35 aa, Artificial Sequence
  synthesized: ShK, K16,Y26, K29
RSCIDTIPKSRCTAFKCKHSMKYRLYFCKKTCGTC

SEQ ID NO: 732 - protein, 35 aa, Artificial Sequence
  synthesized: ShK, K16
RSCIDTIPKSRCTAFKCKHSMKYRLSFCRKTCGTC

SEQ ID NO: 733 - protein, 36 aa, Artificial Sequence
  synthesized: ShK-A, K16
RSCIDTIPKSRCTAFKCKHSMKYRLSFCRKTCGTCA

SEQ ID NO: 734 - protein, 94 aa, Artificial Sequence
  synthesized: V1 Alternative A sequence of VH4-34_Q5RQ6E
QVQLREWGAGLLKPSETLSLTCAVYGGSFSGYYWSWIRQPPGKGLEWIGEINHSGSTNYNPSLKSRVTISVDTSKNQFSLKLSSVTAADTAVYY

SEQ ID NO: 735 - protein, 95 aa, Artificial Sequence
  synthesized: V1 Alternative B sequence of VH4-34_Q5RQ6E
QVQLREWGAGLLKPSETLSLTCAVYGGSFSGYYWSWIRQPPGKGLEWIGEINHSGSTNYNPSLKSRVTISVDTSKNQFSLKLSSVTAADTAVYYC

SEQ ID NO: 736 - protein, 94 aa, Artificial Sequence
  synthesized: V1 Alternative A sequence of VH4-34_CDR1-G31DY32K_Q5RQ6E
QVQLREWGAGLLKPSETLSLTCAVYGGSFSDKYWSWIRQPPGKGLEWIGEINHSGSTNYNPSLKSRVTISVDTSKNQFSLKLSSVTAADTAVYY

SEQ ID NO: 737 - protein, 95 aa, Artificial Sequence
  synthesized: V1 Alternative B sequence of VH4-34_CDR1-G31DY32K_Q5RQ6E
QVQLREWGAGLLKPSETLSLTCAVYGGSFSDKYWSWIRQPPGKGLEWIGEINHSGSTNYNPSLKSRVTISVDTSKNQFSLKLSSVTAADTAVYYC

SEQ ID NO: 738 - protein, 94 aa, Artificial Sequence
  synthesized: V1 Alternative A sequence of VH4-34_CDR2-E50S_Q5RQ6E
QVQLREWGAGLLKPSETLSLTCAVYGGSFSGYYWSWIRQPPGKGLEWIGSINHSGSTNYNPSLKSRVTISVDTSKNQFSLKLSSVTAADTAVYY

SEQ ID NO: 739 - protein, 95 aa, Artificial Sequence
  synthesized: V1 Alternative B sequence of VH4-34_CDR2-E50S_Q5RQ6E
QVQLREWGAGLLKPSETLSLTCAVYGGSFSGYYWSWIRQPPGKGLEWIGSINHSGSTNYNPSLKSRVTISVDTSKNQFSLKLSSVTAADTAVYYC

SEQ ID NO: 740 - protein, 94 aa, Artificial Sequence
  synthesized: V1 Alternative A sequence of VH4-34_CDR1-G31DY32K_CDR2-E50S_Q5RQ6E
QVQLREWGAGLLKPSETLSLTCAVYGGSFSDKYWSWIRQPPGKGLEWIGSINHSGSTNYNPSLKSRVTISVDTSKNQFSLKLSSVTAADTAVYY

SEQ ID NO: 741 - protein, 95 aa, Artificial Sequence
  synthesized: V1 Alternative B sequence of VH4-34_CDR1-G31DY32K_CDR2-E50S_Q5RQ6E
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYC

SEQ ID NO: 742 - protein, 94 aa, Artificial Sequence
  synthesized: V1 Alternative A sequence of VH4-34_CDR1-Cow_Q5RQ6E
QVQLREWGAGLLKPSETLSLTCTASGFSLSDKAVGWIRQPPGKGLEWIGEINHSGSTNYNPSLKSRVTISVDTSKNQFSLKLSSVTAADTAVYY

SEQ ID NO: 743 - protein, 95 aa, Artificial Sequence
  synthesized: V1 Alternative B sequence of VH4-34_CDR1-Cow_Q5RQ6E
QVQLREWGAGLLKPSETLSLTCTASGFSLSDKAVGWIRQPPGKGLEWIGEINHSGSTNYNPSLKSRVTISVDTSKNQFSLKLSSVTAADTAVYYC

SEQ ID NO: 744 - protein, 94 aa, Artificial Sequence
  synthesized: V1 Alternative A sequence of VH4-34_CDR2-Cow_Q5RQ6E
QVQLREWGAGLLKPSETLSLTCAVYGGLGSIDTGGNTGSFSGYYWSWIRQPPGKGLEWYNPSLKSRVTISVDTSKNQFSLKLSSVTAADTAVYY

SEQ ID NO: 745 - protein, 95 aa, Artificial Sequence
  synthesized: V1 Alternative B sequence of VH4-34_CDR2-Cow_Q5RQ6E
QVQLREWGAGLLKPSETLSLTCAVYGGLGSIDTGGNTGSFSGYYWSWIRQPPGKGLEWYNPSLKSRVTISVDTSKNQFSLKLSSVTAADTAVYYC

SEQ ID NO: 746 - protein, 94 aa, Artificial Sequence
  synthesized: V1 Alternative A sequence of VH4-34_CDR1-Cow_CDR2-E50S_Q5RQ6E
QVQLREWGAGLLKPSETLSLTCTASGFSLSDKAVGWIRQPPGKGLEWIGSINHSGSTNYNPSLKSRVTISVDTSKNQFSLKLSSVTAADTAVYY

SEQ ID NO: 747 - protein, 95 aa, Artificial Sequence
  synthesized: V1 Alternative B sequence of VH4-34_CDR1-Cow_CDR2-E50S_Q5RQ6E
QVQLREWGAGLLKPSETLSLTCTASGFSLSDKAVGWIRQPPGKGLEWIGSINHSGSTNYNPSLKSRVTISVDTSKNQFSLKLSSVTAADTAVYYC

SEQ ID NO: 748 - protein, 94 aa, Artificial Sequence
  synthesized: V1 Alternative A sequence of VH4-34_CDR1-Cow_CDR2-Cow_Q5RQ6E
QVQLREWGAGLLKPSETLSLTCTASGFSLSDKAVGWIRQPPGKGLEWLGSIDTGGNTGYNPSLKSRVTISVDTSKNQFSLKLSSVTAADTAVYY

SEQ ID NO: 749 - protein, 95 aa, Artificial Sequence
  synthesized: V1 Alternative N sequence of VH4-34_CDR1-Cow_CDR2-Cow_Q5RQ6E
QVQLREWGAGLLKPSETLSLTCTASGFSLSDKAVGWIRQPPGKGLEWLGSIDTGGNTGYNPSLKSRVTISVDTSKNQFSLKLSSVTAADTAVYYC

SEQ ID NO: 750 - protein, 89 aa, Artificial Sequence
  synthesized: VL of VL1-51 S2A, T5N, P8S, A12G ,A13S, P14L, K46R, L47T, D51G, N52D, N53T
QAVLNQPSSVSGSLGQKVTISCSGSSSNIGNNYVSWYQQLPGTAPRTLIYGDTKRPSGIPDRFSGSKSGTSATLGITGLQTGDEADYYC

SEQ ID NO: 751 - protein, 89 aa, Artificial Sequence
  synthesized: VL of VL1-51 S2A, T5N, P8S, A12G ,A13S, P14L, K46R, L47T,  D51G, N52D, N53T, K54S, P56A
QAVLNQPSSVSGSLGQKVTISCSGSSSNIGNNYVSWYQQLPGTAPRTLIYGDTSRASGIPDRFSGSKSGTSATLGITGLQTGDEADYYC

SEQ ID NO: 752 - protein, 89 aa, Artificial Sequence
  synthesized: VL of VL1-51 I29V, N32G, K46R, L47T, D51G, N52D, N53T
QSVLTQPPSVSAAPGQKVTISCSGSSSNVGNGYVSWYQQLPGTAPRTLIYGDTKRPSGIPDRFSGSKSGTSATLGITGLQTGDEADYYC

SEQ ID NO: 753 - protein, 89 aa, Artificial Sequence
  synthesized: VL of VL1-51 I29V, N32G, K46R, L47T, D51G, N52D, N53T, K54S, P56A
QSVLTQPPSVSAAPGQKVTISCSGSSSNVGNGYVSWYQQLPGTAPRTLIYGDTSRASGIPDRFSGSKSGTSATLGITGLQTGDEADYYC

SEQ ID NO: 754 - protein, 11 aa, Artificial Sequence
  synthesized: CDR3 in BLV1H12 Light Chain
ASAEDSSSNAV

SEQ ID NO: 755 - protein, 10 aa, Artificial Sequence
  synthesized: J region after CDR3 in BLV1H12 Light Chain
FGSGTTLTVL

SEQ ID NO: 756 - protein, 106 aa, Artificial Sequence
  synthesized: Human Light Chain Lambda Constant Region
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 757 - DNA, 438 bp, Artificial Sequence
  synthesized: BLV1H12-CDR3-GGS1:1-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcgagacctactatggttcgggtctcggaggaagctcttatacctacaattatgaatggcatgtggatgtctggggacagggcctgctggtgacagtctctagtgctagc

SEQ ID NO: 758 - DNA, 447 bp, Artificial Sequence
  synthesized: BLV1H12-CDR3-GGS1:2-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcgagacctactatggttcgggtctcggaggaagcggaggaagctcttatacctacaattatgaatggcatgtggatgtctggggacagggcctgctggtgacagtctctagtgctagc

SEQ ID NO: 759 - DNA, 447 bp, Artificial Sequence
  synthesized: BLV1H12-CDR3-GGS2:1-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcgagacctactatggttcgggtctcggaggaagctcttatacctacaattatgaatggcatgtggatgtctggggacagggcctgctggtgacagtctctagtgctagc

SEQ ID NO: 760 - DNA, 456 bp, Artificial Sequence
  synthesized: BLV1H12-CDR3-GGS2:2-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcgagacctactatggttcgggtctcggaggaagcggaggaagctcttatacctacaattatgaatggcatgtggatgtctggggacagggcctgctggtgacagtctctagtgctagc

SEQ ID NO: 761 - DNA, 465 bp, Artificial Sequence
  synthesized: BLV1H12-CDR3-GGS2:3-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcgagacctactatggttcgggtctcggaggaagcggaggaagcggaggaagctcttatacctacaattatgaatggcatgtggatgtctggggacagggcctgctggtgacagtctctagtgctagc

SEQ ID NO: 762 - DNA, 474 bp, Artificial Sequence
  synthesized: BLV1H12-CDR3-GGS2:4-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcgagacctactatggttcgggtctcggaggaagcggaggaagcggaggaagcggaggaagctcttatacctacaattatgaatggcatgtggatgtctggggacagggcctgctggtgacagtctctagtgctagc

SEQ ID NO: 763 - DNA, 465 bp, Artificial Sequence
  synthesized: BLV1H12-CDR3-GGS3:2-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcgagacctactatggttcgggtctcggaggaagcggaggaagctcttatacctacaattatgaatggcatgtggatgtctggggacagggcctgctggtgacagtctctagtgctagc

SEQ ID NO: 764 - DNA, 474 bp, Artificial Sequence
  synthesized: BLV1H12-CDR3-GGS3:3-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcgagacctactatggttcgggtctcggaggaagcggaggaagcggaggaagctcttatacctacaattatgaatggcatgtggatgtctggggacagggcctgctggtgacagtctctagtgctagc

SEQ ID NO: 765 - DNA, 474 bp, Artificial Sequence
  synthesized: BLV1H12-CDR3-GGS4:2-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcggaggaagcgagacctactatggttcgggtctcggaggaagcggaggaagctcttatacctacaattatgaatggcatgtggatgtctggggacagggcctgctggtgacagtctctagtgctagc

SEQ ID NO: 766 - DNA, 459 bp, Artificial Sequence
  synthesized: BLV1H12-CDR3-G4Sx1-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggatgagacctactatggttcagggtctctggaggtggtggatcttcttatacctacaattatgaatggcatgtggatgtctggggacagggcctgctggtgacagtctctagtgctagc

SEQ ID NO: 767 - DNA, 519 bp, Artificial Sequence
  synthesized: BLV1H12-CDR3-G4Sx3-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggatgagacctactatggttcagggtctctggaggtggtggatctggtggaggaggcagtggaggtggtggcagctcttatacctacaattatgaatggcatgtggatgtctggggacagggcctgctggtgacagtctctagtgctagc

SEQ ID NO: 768 - DNA, 24 bp, Artificial Sequence
  synthesized: BsaI containing Nucleotide sequence I
gagacctactatggttcgggtctc

SEQ ID NO: 769 - DNA, 25 bp, Artificial Sequence
  Synthesized: BsaI containing Nucleotide sequence II
gagacctactatggttcagggtctc

SEQ ID NO: 770 - protein, 173 aa, Artificial Sequence
  synthesized: BLV1H12-CDR3-GGS1:1-Moka
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGINVKCSLPQQCIKPCKDAGMRFGKCMNKKCRCYSGGSSYTYNYEWHVDVWGQGLLVTVSSAS

SEQ ID NO: 771 - protein, 176 aa, Artificial Sequence
  synthesized: BLV1H12-CDR3-GGS1:2-Moka
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGINVKCSLPQQCIKPCKDAGMRFGKCMNKKCRCYSGGSGGSSYTYNYEWHVDVWGQGLLVTVSSAS

SEQ ID NO: 772 - protein, 176 aa, Artificial Sequence
  synthesized: BLV1H12-CDR3-GGS2:1-Moka
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGINVKCSLPQQCIKPCKDAGMRFGKCMNKKCRCYSGGSSYTYNYEWHVDVWGQGLLVTVSSAS

SEQ ID NO: 773 - protein, 179 aa, Artificial Sequence
  synthesized: BLV1H12-CDR3-GGS2:2-Moka
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGINVKCSLPQQCIKPCKDAGMRFGKCMNKKCRCYSGGSGGSSYTYNYEWHVDVWGQGLLVTVSSAS

SEQ ID NO: 774 - protein, 185 aa, Artificial Sequence
  synthesized: BLV1H12-CDR3-GGS3:3-Moka
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGSGINVKCSLPQQCIKPCKDAGMRFGKCMNKKCRCYSGGSGGSGGSSYTYNYEWHVDVWGQGLLVTVSSAS

SEQ ID NO: 775 - protein, 194 aa, Artificial Sequence
  synthesized: BLV1H12-CDR3-G4Sx3-ProTxII
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGYCQKWMWTCDSERKCCEGMVCRLWCKKKLWGGGGSGGGGSGGGGSSYTYNYEWHVDVWGQGLLVTVSSAS

SEQ ID NO: 776 - protein, 198 aa, Artificial Sequence
  synthesized: BLV1H12-CDR3-G4Sx3-GPTX toxin
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGDCLGFMRKCIPDNDKCCRPNLVCSRTHKWCKYVFGGGGSGGGGSGGGGSSYTYNYEWHVDVWGQGLLVTVSSAS

SEQ ID NO: 777 - protein, 202 aa, Artificial Sequence
  synthesized: BLV1H12-CDR3-G4Sx3-OSK1 P12, K16, D20 toxin
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGGVIINVKCKISPQCLKPCKDAGMRFGKCMNGKCHCTPKGGGGSGGGGSGGGGSSYTYNYEWHVDVWGQGLLVTVSSAS

SEQ ID NO: 778 - protein, 202 aa, Artificial Sequence
  synthesized: BLV1H12-CDR3-G4Sx3-OSK1 K16, D20 toxin
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGGVIINVKCKISRQCLKPCKDAGMRFGKCMNGKCHCTPKGGGGSGGGGSGGGGSSYTYNYEWHVDVWGQGLLVTVSSAS

SEQ ID NO: 779 - protein, 199 aa, Artificial Sequence
  synthesized: BLV1H12-CDR3-G4Sx3-ShK toxin
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGRSCIDTIPKSRCTAFQCKHSMKYRLSFCRKTCGTCGGGGSGGGGSGGGGSSYTYNYEWHVDVWGQGLLVTVSSAS

SEQ ID NO: 780 - protein, 216 aa, Artificial Sequence
  synthesized: VL-CL sequence of VL1-51 S2A, T5N, P8S, A12G, A13S, P14L, K46R, L47T, D51G, N52D, N53T
QAVLNQPSSVSGSLGQKVTISCSGSSSNIGNNYVSWYQQLPGTAPRTLIYGDTKRPSGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 781 - protein, 216 aa, Artificial Sequence
  synthesized: VL-CL sequence of VL1-51 S2A, T5N, P8S, A12G, A13S, P14L, K46R, L47T,  D51G, N52D, N53T, K54S, P56A
QAVLNQPSSVSGSLGQKVTISCSGSSSNIGNNYVSWYQQLPGTAPRTLIYGDTSRASGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 782 - protein, 216 aa, Artificial Sequence
  synthesized: VL-CL sequence of VL1-51 I29V, N32G, K46R, L47T, D51G, N52D, N53T
QSVLTQPPSVSAAPGQKVTISCSGSSSNVGNGYVSWYQQLPGTAPRTLIYGDTKRPSGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 783 - protein, 216 aa, Artificial Sequence
  synthesized: VL-CL sequence of VL1-51 I29V, N32G, K46R, L47T, D51G, N52D, N53T, K54S, P56A
QSVLTQPPSVSAAPGQKVTISCSGSSSNVGNGYVSWYQQLPGTAPRTLIYGDTSRASGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 784 - protein, 207 aa, Artificial Sequence
  synthesized: VH sequence of VH4-34+CDR3-IL8_Q5RQ6E
QVQLREWGAGLLKPSETLSLTCAVYGGSFSGYYWSWIRQPPGKGLEWIGEINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 785 - protein, 207 aa, Artificial Sequence
  synthesized: VH sequence of VH4-34+CDR3-IL8_CDR1-G31DY32K_Q5RQ6E
QVQLREWGAGLLKPSETLSLTCAVYGGSFSDKYWSWIRQPPGKGLEWIGEINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 786 - protein, 207 aa, Artificial Sequence
  synthesized: VH sequence of VH4-34+CDR3-IL8_CDR2-E50S_Q5RQ6E
QVQLREWGAGLLKPSETLSLTCAVYGGSFSGYYWSWIRQPPGKGLEWIGSINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 787 - protein, 207 aa, Artificial Sequence
  synthesized: VH sequence of VH4-34+CDR3-IL8_CDR1-G31DY32K_CDR2-E50S_Q5RQ6E
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 788 - protein, 207 aa, Artificial Sequence
  synthesized: VH sequence of VH4-34+CDR3-IL8_CDR1-Cow_Q5RQ6E
QVQLREWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 789 - protein, 207 aa, Artificial Sequence
  synthesized: VH sequence of VH4-34+CDR3-IL8_CDR2-Cow_Q5RQ6E
QVQLREWGAGLLKPSETLSLTCAVYGGLGSIDTGGNTGSFSGYYWSWIRQPPGKGLEWYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 790 - protein, 207 aa, Artificial Sequence
  synthesized: VH sequence of VH4-34+CDR3-IL8_CDR1-Cow_CDR2-E50S_Q5RQ6E
QVQLREWGAGLLKPSETLSLTCTASGFSLSDKAVGWIRQPPGKGLEWIGSINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 791 - protein, 207 aa, Artificial Sequence
  synthesized: VH sequence of VH4-34+CDR3-IL8_CDR1-Cow_CDR2-Cow_Q5RQ6E
QVQLREWGAGLLKPSETLSLTCTASGFSLSDKAVGWIRQPPGKGLEWLGSIDTGGNTGYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSS

SEQ ID NO: 792 - protein, 216 aa, Artificial Sequence
  synthesized: VL1-51 S2A, T5N, P8S, A12G ,A13S, P14L, D51G, N52D, N53T
QAVLNQPSSVSGSLGQKVTISCSGSSSNIGNNYVSWYQQLPGTAPKLLIYGDTKRPSGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 793 - protein, 209 aa, Artificial Sequence
  synthesized: VH4-34+CDR3-IL8
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 794 - protein, 209 aa, Artificial Sequence
  synthesized: VH4-34+CDR3-IL8_CDR1 Cow
QVQLQQWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 795 - protein, 209 aa, Artificial Sequence
  synthesized: VH4-34+CDR3-IL8_CDR2 Cow
QVQLQQWGAGLLKPSETLSLTCAVYGGSFSGYYWSWIRQPPGKGLEWLGSIDTGGNTGYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 796 - protein, 209 aa, Artificial Sequence
  synthesized: VH4-34+CDR3-IL8_CDR1 G31D, Y32K
QVQLQQWGAGLLKPSETLSLTCAVYGGSFSDKYWSWIRQPPGKGLEWIGEINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 797 - protein, 209 aa, Artificial Sequence
  synthesized: VH4-34+CDR3-IL8_CDR2 E50S
QVQLQQWGAGLLKPSETLSLTCAVYGGSFSGYYWSWIRQPPGKGLEWIGSINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 798 - protein, 209 aa, Artificial Sequence
  synthesized: VH4-34+CDR3-IL8_CDR1 Cow_CDR2 Cow
QVQLQQWGAGLLKPSETLSLTCTASGFSLSDKAVGWIRQPPGKGLEWLGSIDTGGNTGYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 799 - protein, 209 aa, Artificial Sequence
  synthesized: VH4-34+CDR3-IL8_CDR1 Cow_CDR2 E50S
QVQLQQWGAGLLKPSETLSLTCTASGFSLSDKAVGWIRQPPGKGLEWIGSINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 800 - protein, 209 aa, Artificial Sequence
  synthesized: VH4-34+CDR3-IL8_CDR1 G31D,Y32K_CDR2 E50S
QVQLQQWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 801 - protein, 216 aa, Artificial Sequence
  synthesized: VL1-51 I29V, N32G
QSVLTQPPSVSAAPGQKVTISCSGSSSNVGNGYVSWYQQLPGTAPKLLIYDNNKRPSGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 802 - protein, 216 aa, Artificial Sequence
  synthesized: VL1-51 D51G, N52D, N53T
QSVLTQPPSVSAAPGQKVTISCSGSSSNIGNNYVSWYQQLPGTAPKLLIYGDTKRPSGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 803 - protein, 216 aa, Artificial Sequence
  synthesized: VL1-51 D51G, N52D, N53T, K54S, P56A
QSVLTQPPSVSAAPGQKVTISCSGSSSNIGNNYVSWYQQLPGTAPKLLIYGDTSRASGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 804 - protein, 216 aa, Artificial Sequence
  synthesized: VL1-51 S2A, T5N, P8S, A12G, A13S, P14L
QAVLNQPSSVSGSLGQKVTISCSGSSSNIGNNYVSWYQQLPGTAPKLLIYDNNKRPSGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 805 - protein, 216 aa, Artificial Sequence
  synthesized: VL1-51
QSVLTQPPSVSAAPGQKVTISCSGSSSNIGNNYVSWYQQLPGTAPKLLIYDNNKRPSGIPDRFSGSKSGTSATLGITGLQTGDEADYYCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 806 - DNA, 105 bp, Artificial Sequence
  Synthesized: MOKA Toxin
ggcatcaacgtgaagtgcagcctgccccagcagtgcatcaagccctgcaaggacgccggcatgagattcggcaagtgcatgaacaagaagtgcagatgctacagc

SEQ ID NO: 807 - protein, 216 aa, Artificial Sequence
  synthesized: Lambda LC translation
QAVLNQPSSVSGSLGQRVSITCSGSSSNVGNGYVSWYQLIPGSAPRTLIYGDTSRASGVPDRFSGSRSGNTATLTISSLQAEDEADYFCASAEDSSSNAVFGSGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 808 - protein, 60 aa, Artificial Sequence
  synthesized: Shk toxin
GVPDRFSGSRSGNTATLTISSLQAEDEADYFCASAEDSSSNAVFGSGTTLTVLGQPKAAP

SEQ ID NO: 809 - protein, 60 aa, Artificial Sequence
  synthesized: ProTxII toxin
SVTLFPPSSEELQANKATLVCLISDFYPGAVTVAWKADSSPVKAGVETTTPSKQSNNKYA

SEQ ID NO: 810 - protein, 39 aa, Artificial Sequence
  synthesized: GPTX toxin
ASSYLSLTPEQWKSHRSYSCQVTHEGSTVEKTVAPTECS

SEQ ID NO: 811 - protein, 114 aa, Artificial Sequence
  synthesized: OSK1 toxin (P12, K16, D20)
GGCGTGATCATCAACGTGAAATGCAAGATCAGCCCCCAGTGCCTGAAGCCCTGCAAGGACGCCGGCATGAGGTTCGGGAAGTGCATGAACGGCAAGTGCCACTGCACCCCCAAG

SEQ ID NO: 812 - protein, 114 aa, Artificial Sequence
  synthesized: OSK1 toxin (K16 and D20)
GGCGTGATCATCAACGTGAAGTGCAAGATCAGCAGGCAGTGCCTGAAGCCCTGCAAGGACGCCGGCATGAGGTTCGGTAAGTGCATGAACGGCAAGTGCCACTGCACCCCCAAG

SEQ ID NO: 813 - protein, 1 aa, Artificial Sequence
  synthesized: linker sequence
G

SEQ ID NO: 814 - protein, 2 aa, Artificial Sequence
  synthesized: linker sequence
GG

SEQ ID NO: 815 - protein, 3 aa, Artificial Sequence
  synthesized: linker sequence
GGG

SEQ ID NO: 816 - protein, 4 aa, Artificial Sequence
  synthesized: linker sequence
GGGG

SEQ ID NO: 817 - protein, 9 aa, Artificial Sequence
  synthesized: linker sequence
GGGGGSGGS

SEQ ID NO: 818 - protein, 12 aa, Artificial Sequence
  synthesized: linker sequence
GGGGSGGGGSGG

SEQ ID NO: 819 - protein, 8 aa, Artificial Sequence
  synthesized: linker sequence
GGGGSGGS

SEQ ID NO: 820 - protein, 11 aa, Artificial Sequence
  synthesized: linker sequence
GGGGSGGSGGS

SEQ ID NO: 821 - protein, 14 aa, Artificial Sequence
  synthesized: linker sequence
GGGGSGGSGGSGGS

SEQ ID NO: 822 - protein, 4 aa, Artificial Sequence
  synthesized: linker sequence
GGSG

SEQ ID NO: 823 - protein, 5 aa, Artificial Sequence
  synthesized: linker sequence
GGSGG

SEQ ID NO: 824 - protein, 7 aa, Artificial Sequence
  synthesized: linker sequence
GGSGGSG

SEQ ID NO: 825 - protein, 8 aa, Artificial Sequence
  synthesized: linker sequence
GGSGGSGG

SEQ ID NO: 826 - protein, 10 aa, Artificial Sequence
  synthesized: linker sequence
GGSGGSGGSG

SEQ ID NO: 827 - protein, 11 aa, Artificial Sequence
  synthesized: linker sequence
GGSGGSGGSGG

SEQ ID NO: 828 - protein, 14 aa, Artificial Sequence
  synthesized: linker sequence
GGSGGSGGSGGSGG

SEQ ID NO: 829 - protein, 3 aa, Artificial Sequence
  synthesized: linker sequence
GSG

SEQ ID NO: 830 - protein, 4 aa, Artificial Sequence
  synthesized: linker sequence
GSGG

SEQ ID NO: 831 - protein, 35 aa, Artificial Sequence
  synthesized: ShK, Q21
RSCIDTIPKSRCTAFQCKHSQKYRLSFCRKTCGTC

SEQ ID NO: 832 - protein, 35 aa, Artificial Sequence
  synthesized: ShK, L21
RSCIDTIPKSRCTAFQCKHSLKYRLSFCRKTCGTC

SEQ ID NO: 833 - protein, 35 aa, Artificial Sequence
  synthesized: ShK, F21
RSCIDTIPKSRCTAFQCKHSFKYRLSFCRKTCGTC

SEQ ID NO: 834 - protein, 35 aa, Artificial Sequence
  synthesized: ShK, I21
RSCIDTIPKSRCTAFQCKHSIKYRLSFCRKTCGTC

SEQ ID NO: 835 - protein, 35 aa, Artificial Sequence
  synthesized: ShK, A21
RSCIDTIPKSRCTAFQCKHSAKYRLSFCRKTCGTC

SEQ ID NO: 836 - DNA, 504 bp, Artificial Sequence
  synthesized: heavy chain BLV1H12 HC GGS1:1 ProTxII of plasmid 131-34
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagctattgccagaagtggatgtggacctgcgatagcgaacggaaatgttgcgaaggcatggtgtgccgcctgtggtgcaagaagaaactctggggaggaagctcttatacctacaattatgaatggcatgtggatgtctggggacagggcctgctggtgacagtctctagtgctagc

SEQ ID NO: 837 - DNA, 513 bp, Artificial Sequence
  synthesized: heavy chain BLV1H12 HC GGS1:2 ProTxII of plasmid 131-35
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagctattgccagaagtggatgtggacctgcgatagcgaacggaaatgttgcgaaggcatggtgtgccgcctgtggtgcaagaagaaactctggggaggaagcggaggaagctcttatacctacaattatgaatggcatgtggatgtctggggacagggcctgctggtgacagtctctagtgctagc

SEQ ID NO: 838 - DNA, 513 bp, Artificial Sequence
  synthesized: heavy chain BLV1H12 HC GGS2:1 ProTxII of plasmid 131-36
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagctattgccagaagtggatgtggacctgcgatagcgaacggaaatgttgcgaaggcatggtgtgccgcctgtggtgcaagaagaaactctggggaggaagctcttatacctacaattatgaatggcatgtggatgtctggggacagggcctgctggtgacagtctctagtgctagc

SEQ ID NO: 839 - DNA, 519 bp, Artificial Sequence
  synthesized: heavy chain BLV1H12 Hc CowV,HuC 1:1GGS G-Moka of plasmid 131-40
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggcatcaacgtgaagtgcagcctgccccagcagtgcatcaagccctgcaaggacgccggcatgagattcggcaagtgcatgaacaagaagtgcagatgctacagcggaggaagctcttatacctacaattatgaatggcatgtggatgtctggggacagggcctgctggtgacagtctctagtgctagc

SEQ ID NO: 840 - DNA, 528 bp, Artificial Sequence
  synthesized: heavy chain BLV1H12 Hc CowV,HuC 1:2GGS G-Moka of plasmid 131-41
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggcatcaacgtgaagtgcagcctgccccagcagtgcatcaagccctgcaaggacgccggcatgagattcggcaagtgcatgaacaagaagtgcagatgctacagcggaggaagcggaggaagctcttatacctacaattatgaatggcatgtggatgtctggggacagggcctgctggtgacagtctctagtgctagc

SEQ ID NO: 841 - DNA, 528 bp, Artificial Sequence
  synthesized: heavy chain BLV1H12 Hc CowV,HuC 2:1GGS G-Moka of plasmid 131-42
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggcatcaacgtgaagtgcagcctgccccagcagtgcatcaagccctgcaaggacgccggcatgagattcggcaagtgcatgaacaagaagtgcagatgctacagcggaggaagctcttatacctacaattatgaatggcatgtggatgtctggggacagggcctgctggtgacagtctctagtgctagc

SEQ ID NO: 842 - DNA, 555 bp, Artificial Sequence
  synthesized: heavy chain BLV1H12 Hc CowV,HuC 3:3GGS G-Moka of plasmid 131-43
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcggcatcaacgtgaagtgcagcctgccccagcagtgcatcaagccctgcaaggacgccggcatgagattcggcaagtgcatgaacaagaagtgcagatgctacagcggaggaagcggaggaagcggaggaagctcttatacctacaattatgaatggcatgtggatgtctggggacagggcctgctggtgacagtctctagtgctagc

SEQ ID NO: 843 - DNA, 516 bp, Artificial Sequence
  synthesized: heavy chain BLV1H12 HC GGS1:1 GG-ProTxII-GG of plasmid 131-37
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggcggctattgccagaagtggatgtggacctgcgatagcgaacggaaatgttgcgaaggcatggtgtgccgcctgtggtgcaagaagaaactctggggcggcggaggaagctcttatacctacaattatgaatggcatgtggatgtctggggacagggcctgctggtgacagtctctagtgctagc

SEQ ID NO: 844 - DNA, 525 bp, Artificial Sequence
  synthesized: heavy chain BLV1H12 HC GGS1:2 GG-ProTxII-GG of plasmid 131-38
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggcggctattgccagaagtggatgtggacctgcgatagcgaacggaaatgttgcgaaggcatggtgtgccgcctgtggtgcaagaagaaactctggggcggcggaggaagcggaggaagctcttatacctacaattatgaatggcatgtggatgtctggggacagggcctgctggtgacagtctctagtgctagc

SEQ ID NO: 845 - DNA, 525 bp, Artificial Sequence
  synthesized: heavy chain BLV1H12 HC GGS2:1 GG-ProTxII-GG of plasmid 131-39
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggcggctattgccagaagtggatgtggacctgcgatagcgaacggaaatgttgcgaaggcatggtgtgccgcctgtggtgcaagaagaaactctggggcggcggaggaagctcttatacctacaattatgaatggcatgtggatgtctggggacagggcctgctggtgacagtctctagtgctagc

SEQ ID NO: 846 - DNA, 522 bp, Artificial Sequence
  synthesized: heavy chain BLV1H12 HC GGS2:2 ProTxII of plasmid 131-44
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagctattgccagaagtggatgtggacctgcgatagcgaacggaaatgttgcgaaggcatggtgtgccgcctgtggtgcaagaagaaactctggggaggaagcggaggaagctcttatacctacaattatgaatggcatgtggatgtctggggacagggcctgctggtgacagtctctagtgctagc

SEQ ID NO: 847 - DNA, 540 bp, Artificial Sequence
  synthesized: heavy chain BLV1H12 HC GGS2:4 ProTxII of plasmid 131-45
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagctattgccagaagtggatgtggacctgcgatagcgaacggaaatgttgcgaaggcatggtgtgccgcctgtggtgcaagaagaaactctggggaggaagcggaggaagcggaggaagcggaggaagctcttatacctacaattatgaatggcatgtggatgtctggggacagggcctgctggtgacagtctctagtgctagc

SEQ ID NO: 848 - DNA, 540 bp, Artificial Sequence
  synthesized: heavy chain BLV1H12 HC GGS4:2 ProTxII of plasmid 131-46
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcggaggaagctattgccagaagtggatgtggacctgcgatagcgaacggaaatgttgcgaaggcatggtgtgccgcctgtggtgcaagaagaaactctggggaggaagcggaggaagctcttatacctacaattatgaatggcatgtggatgtctggggacagggcctgctggtgacagtctctagtgctagc

SEQ ID NO: 849 - DNA, 534 bp, Artificial Sequence
  synthesized: heavy chain BLV1H12 HC GGS2:2 GG-ProTxII-GG of plasmid 131-47
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggcggctattgccagaagtggatgtggacctgcgatagcgaacggaaatgttgcgaaggcatggtgtgccgcctgtggtgcaagaagaaactctggggcggcggaggaagcggaggaagctcttatacctacaattatgaatggcatgtggatgtctggggacagggcctgctggtgacagtctctagtgctagc

SEQ ID NO: 850 - DNA, 543 bp, Artificial Sequence
  synthesized: heavy chain BLV1H12 HC GGS 2:3 GG-ProTxII-GG of plasmid 131-48
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggcggctattgccagaagtggatgtggacctgcgatagcgaacggaaatgttgcgaaggcatggtgtgccgcctgtggtgcaagaagaaactctggggcggcggaggaagcggaggaagcggaggaagctcttatacctacaattatgaatggcatgtggatgtctggggacagggcctgctggtgacagtctctagtgctagc

SEQ ID NO: 851 - DNA, 552 bp, Artificial Sequence
  synthesized: heavy chain BLV1H12 HC GGS 2:4 GG-ProTxII-GG of plasmid 131-49
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggcggctattgccagaagtggatgtggacctgcgatagcgaacggaaatgttgcgaaggcatggtgtgccgcctgtggtgcaagaagaaactctggggcggcggaggaagcggaggaagcggaggaagcggaggaagctcttatacctacaattatgaatggcatgtggatgtctggggacagggcctgctggtgacagtctctagtgctagc

SEQ ID NO: 852 - DNA, 543 bp, Artificial Sequence
  synthesized: heavy chain BLV1H12 HC GGS 3:2 GG-ProTxII-GG of plasmid 131-50
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcggcggctattgccagaagtggatgtggacctgcgatagcgaacggaaatgttgcgaaggcatggtgtgccgcctgtggtgcaagaagaaactctggggcggcggaggaagcggaggaagctcttatacctacaattatgaatggcatgtggatgtctggggacagggcctgctggtgacagtctctagtgctagc

SEQ ID NO: 853 - DNA, 552 bp, Artificial Sequence
  synthesized: heavy chain BLV1H12 HC GGS 3:3 GG-ProTxII-GG of plasmid 131-51
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcggcggctattgccagaagtggatgtggacctgcgatagcgaacggaaatgttgcgaaggcatggtgtgccgcctgtggtgcaagaagaaactctggggcggcggaggaagcggaggaagcggaggaagctcttatacctacaattatgaatggcatgtggatgtctggggacagggcctgctggtgacagtctctagtgctagc

SEQ ID NO: 854 - DNA, 552 bp, Artificial Sequence
  synthesized: heavy chain BLV1H12 HC GGS 4:2 GG-ProTxII-GG of plasmid 131-52
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggaggaagcggaggaagcggaggaagcggaggaagcggcggctattgccagaagtggatgtggacctgcgatagcgaacggaaatgttgcgaaggcatggtgtgccgcctgtggtgcaagaagaaactctggggcggcggaggaagcggaggaagctcttatacctacaattatgaatggcatgtggatgtctggggacagggcctgctggtgacagtctctagtgctagc

SEQ ID NO: 855 - DNA, 582 bp, Artificial Sequence
  synthesized: heavy chain BLV1H12 GTLV 3xG4S ProTxII of plasmid 131-56
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggatactgccagaagtggatgtggacctgcgacagcgagaggaagtgctgcgagggcatggtgtgcaggctgtggtgcaagaagaagctgtggggaggtggtggatctggtggaggaggcagtggaggtggtggcagctcttatacctacaattatgaatggcatgtggatgtctggggccaaggaaccctggtcaccgtctcctcagctagc

SEQ ID NO: 856 - DNA, 597 bp, Artificial Sequence
  synthesized: heavy chain BLV1H12 GTLV 3xG4S ShK of plasmid 131-59
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcatgaagtacaggctgagcttctgcaggaagacctgcggcacctgcggaggtggtggatctggtggaggaggcagtggaggtggtggcagctcttatacctacaattatgaatggcatgtggatgtctggggccaaggaaccctggtcaccgtctcctcagctagc

SEQ ID NO: 857 - DNA, 606 bp, Artificial Sequence
  synthesized: heavy chain BLV1H12 GTLV 3xG4S OSK1 (K16, D20) of plasmid 131-60
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaggcgtgatcatcaacgtgaagtgcaagatcagcaggcagtgcctgaagccctgcaaggacgccggcatgaggttcggtaagtgcatgaacggcaagtgccactgcacccccaagggaggtggtggatctggtggaggaggcagtggaggtggtggcagctcttatacctacaattatgaatggcatgtggatgtctggggccaaggaaccctggtcaccgtctcctcagctagc

SEQ ID NO: 858 - DNA, 606 bp, Artificial Sequence
  synthesized: heavy chain BLV1H12 GTLV 3xG4S OSK1 (P12,K16,D20) of plasmid 131-61
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaggcgtgatcatcaacgtgaaatgcaagatcagcccccagtgcctgaagccctgcaaggacgccggcatgaggttcgggaagtgcatgaacggcaagtgccactgcacccccaagggaggtggtggatctggtggaggaggcagtggaggtggtggcagctcttatacctacaattatgaatggcatgtggatgtctggggccaaggaaccctggtcaccgtctcctcagctagc

SEQ ID NO: 859 - DNA, 594 bp, Artificial Sequence
  synthesized: heavy chain BLV1H12 cowV HumanC 3xG4S GPTX of plasmid 131-62
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggagactgcctgggcttcatgaggaagtgcatccccgacaacgacaagtgctgcaggcccaacctggtgtgcagcaggacccacaagtggtgcaagtacgtgttcggaggtggtggatctggtggaggaggcagtggaggtggtggcagctcttatacctacaattatgaatggcatgtggatgtctggggccaaggaaccctggtcaccgtctcctcagctagc

SEQ ID NO: 860 - DNA, 486 bp, Artificial Sequence
  synthesized: heavy chain BLV1H12 GTLV 6xG4S  of plasmid 131-64
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaggtggatctggtggaggaggcagtggaggtggtggcagctcttatacctacaattatgaatggcatgtggatgtctggggccaaggaaccctggtcaccgtctcctcagctagc

SEQ ID NO: 861 - DNA, 459 bp, Artificial Sequence
  synthesized: heavy chain BLV1H12 GTLV 1xG4S BsaIs (wStop) of plasmid 131-65
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggatgagacctactatggttcagggtctctggaggtggtggatcttcttatacctacaattatgaatggcatgtggatgtctggggccaaggaaccctggtcaccgtctcctcagctagc

SEQ ID NO: 862 - DNA, 582 bp, Artificial Sequence
  synthesized: heavy chain BLV1H12 GLLV 3xG4S ProTxII of plasmid 131-66
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggatactgccagaagtggatgtggacctgcgacagcgagaggaagtgctgcgagggcatggtgtgcaggctgtggtgcaagaagaagctgtggggaggtggtggatctggtggaggaggcagtggaggtggtggcagctcttatacctacaattatgaatggcatgtggatgtctggggacagggcctgctggtgacagtctctagtgctagc

SEQ ID NO: 863 - DNA, 597 bp, Artificial Sequence
  synthesized: heavy chain BLV1H12 Hc CowV,HuC GLLV 3xG4S ShKtoxin of plasmid 131-67
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcatgaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 864 - DNA, 606 bp, Artificial Sequence
  synthesized: heavy chain BLV1H12 GLLV 3xG4S OSK1 (K16,D20) of plasmid 131-68
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaggcgtgatcatcaacgtgaagtgcaagatcagcaggcagtgcctgaagccctgcaaggacgccggcatgaggttcggtaagtgcatgaacggcaagtgccactgcacccccaagggaggtggtggatctggtggaggaggcagtggaggtggtggcagctcttatacctacaattatgaatggcatgtggatgtctggggacagggcctgctggtgacagtctctagtgctagc

SEQ ID NO: 865 - DNA, 606 bp, Artificial Sequence
  synthesized: heavy chain BLV1H12 GLLV 3xG4S OSK1 (P12,K16,D20) of plasmid 131-69
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaggcgtgatcatcaacgtgaaatgcaagatcagcccccagtgcctgaagccctgcaaggacgccggcatgaggttcgggaagtgcatgaacggcaagtgccactgcacccccaagggaggtggtggatctggtggaggaggcagtggaggtggtggcagctcttatacctacaattatgaatggcatgtggatgtctggggacagggcctgctggtgacagtctctagtgctagc

SEQ ID NO: 866 - DNA, 594 bp, Artificial Sequence
  synthesized: heavy chain BLV1H12 GLLV 3xG4S GpTx-1 of plasmid 131-70
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggagactgcctgggcttcatgaggaagtgcatccccgacaacgacaagtgctgcaggcccaacctggtgtgcagcaggacccacaagtggtgcaagtacgtgttcggaggtggtggatctggtggaggaggcagtggaggtggtggcagctcttatacctacaattatgaatggcatgtggatgtctggggacagggcctgctggtgacagtctctagtgctagc

SEQ ID NO: 867 - DNA, 627 bp, Artificial Sequence
  synthesized: heavy chain VH4-34 CD3 IL8_CDR1-Cow_CDR2-Human of plasmid 132-07
caggtgcagctacagcagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 868 - DNA, 627 bp, Artificial Sequence
  synthesized: heavy chain VH4-34 CD3 IL8_CDR1-Cow_CDR2-Cow of plasmid 132-09
caggtgcagctacagcagtggggcgcaggactgttgaagccttcggagacgctgtccctcacctgcacagcaagcgggttttcactgagcgacaaggcagtgggatggattcgccagcccccagggaaggggctggagtggctgggcagcatcgataccggcgggaacacagggtacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 869 - DNA, 627 bp, Artificial Sequence; identical to SEQ ID NO: 868
  synthesized: heavy chain VH4-34 CD3 IL8_CDR1-Cow_CDR2-Cow of plasmid 132-09

SEQ ID NO: 870 - DNA, 627 bp, Artificial Sequence
  synthesized: heavy chain VH4-34 CD3 IL8_CDR1-G31DY32K_CDR2-E50S of plasmid 132-05
caggtgcagctacagcagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 871 - DNA, 627 bp, Artificial Sequence; identical to SEQ ID NO: 868
  synthesized: heavy chain VH4-34 CD3 IL8_CDR1-Cow_CDR2-Cow of plasmid 132-09

SEQ ID NO: 872 - DNA, 513 bp, Artificial Sequence; identical to SEQ ID NO: 392
  synthesized: heavy chain BLV1H12 HC CowV, Human CH1-2-3(107) of plasmid 131-74

SEQ ID NO: 873 - DNA, 627 bp, Artificial Sequence
  synthesized: heavy chain BLV1H12 HC CowV, CDR3 IL-8,  Human CH1-2-3 (105) of plasmid 131-76
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggcagcggttcttatacctacaattatgaatggcatgtggatgtctggggacagggcctgctggtgacagtctctagtgctagc

SEQ ID NO: 874 - DNA, 654 bp, Artificial Sequence
  synthesized: heavy chain BLV1H12 CowV 1xGGGGS linker- IL-8 -HumanCH123 of plasmid 131-71
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggaccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggaggtggtggatcttcttatacctacaattatgaatggcatgtggatgtctggggacagggcctgctggtgacagtctctagtgctagc

SEQ ID NO: 875 - DNA, 714 bp, Artificial Sequence
  synthesized: heavy chain BLV1H12 CowV 3xGGGGS linker- IL-8 -HumanCH123 of plasmid 131-72
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggaccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggaggtggtggatctggtggaggaggcagtggaggtggtggcagctcttatacctacaattatgaatggcatgtggatgtctggggacagggcctgctggtgacagtctctagtgctagc

SEQ ID NO: 876 - DNA, 714 bp, Artificial Sequence
  synthesized: heavy chain VH4-34 Q5RQ6E, G31DY32K, E50S, 3xG4S, IL-8 of plasmid 132-37
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggaggtggtggatctggtggaggaggcagtggaggtggtggcagctcttatacctacaattatgaatggcatgtggatgtctggggacagggcctgctggtgacagtctctagtgctagc

SEQ ID NO: 877 - DNA, 597 bp, Artificial Sequence
  synthesized: heavy chain VH4-34 Q5RQ6E, G31DY32K, E50S, 3xG4S, ShK of plasmid 132-35
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcatgaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 878 - DNA, 555 bp, Artificial Sequence
  synthesized: heavy chain VH4-34 Q5RQ6E, G31DY32K, E50S, 3:3GGS, MOKA of plasmid 132-36
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggaggaagcggaggaagcggaggaagcggcatcaacgtgaagtgcagcctgccccagcagtgcatcaagccctgcaaggacgccggcatgagattcggcaagtgcatgaacaagaagtgcagatgctacagcggaggaagcggaggaagcggaggaagctcttatacctacaattatgaatggcatgtggatgtctggggacagggcctgctggtgacagtctctagtgctagc

SEQ ID NO: 879 - DNA, 597 bp, Artificial Sequence
  synthesized: heavy chain VH4-34 Q5RQ6E, CDR1 Cow, 3xG4S, ShK of plasmid 132-38
caggtgcagctaagagagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcatgaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 880 - DNA, 714 bp, Artificial Sequence
  synthesized: heavy chain VH4-34 Q5RQ6E, CDR1 Cow,3xG4S, IL-8 of plasmid 132-40
caggtgcagctaagagagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaccaaggagtgctaaagaacttagatgtcagtgcataaagacatactccaaacctttccaccccaagttcatcaaggagctgagagtgattgagagtggaccacactgcgccaacacagagattattgtaaagctttctgatgggagagagctctgcctggaccccaaggaaaactgggtgcagagggtcgtggagaagttcttgaagagggctgagaactcaggaggtggtggatctggtggaggaggcagtggaggtggtggcagctcttatacctacaattatgaatggcatgtggatgtctggggacagggcctgctggtgacagtctctagtgctagc

SEQ ID NO: 881 - DNA, 555 bp, Artificial Sequence
  synthesized: heavy chain VH4-34 Q5RQ6E, CDR1 Cow,3:3GGS, MOKA of plasmid 132-39
caggtgcagctaagagagtggggcgcaggactgttgaagccttcggagacgctgtccctcacctgcacagcaagcgggttttcactgagcgacaaggcagtgggatggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggaggaagcggaggaagcggaggaagcggcatcaacgtgaagtgcagcctgccccagcagtgcatcaagccctgcaaggacgccggcatgagattcggcaagtgcatgaacaagaagtgcagatgctacagcggaggaagcggaggaagcggaggaagctcttatacctacaattatgaatggcatgtggatgtctggggacagggcctgctggtgacagtctctagtgctagc

SEQ ID NO: 882 - DNA, 582 bp, Artificial Sequence
  synthesized: heavy chain VH4-34 Q5RQ6E, G31DY32K, E50S, 3xG4S, ProTxII of plasmid 132-31
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggatactgccagaagtggatgtggacctgcgacagcgagaggaagtgctgcgagggcatggtgtgcaggctgtggtgcaagaagaagctgtggggaggtggtggatctggtggaggaggcagtggaggtggtggcagctcttatacctacaattatgaatggcatgtggatgtctggggacagggcctgctggtgacagtctctagtgctagc

SEQ ID NO: 883 - DNA, 594 bp, Artificial Sequence
  synthesized: heavy chain VH4-34 Q5RQ6E, G31DY32K, E50S, 3xG4S, GPTX1 of plasmid 132-34
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggagactgcctgggcttcatgaggaagtgcatccccgacaacgacaagtgctgcaggcccaacctggtgtgcagcaggacccacaagtggtgcaagtacgtgttcggaggtggtggatctggtggaggaggcagtggaggtggtggcagctcttatacctacaattatgaatggcatgtggatgtctggggacagggcctgctggtgacagtctctagtgctagc

SEQ ID NO: 884 - DNA, 423 bp, Artificial Sequence
  synthesized: heavy chain VH4-34 Q5RQ6E, G31DY32K, E50S, CDR3 CowStalks-3xGGS of plasmid 132-49
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggaggaagcggaggaagcggaggaagctcttatacctacaattatgaatggcatgtggatgtctggggacagggcctgctggtgacagtctctagtgctagc

SEQ ID NO: 885 - DNA, 537 bp, Artificial Sequence
  synthesized: heavy chain VH4-34 Q5RQ6E, G31DY32K, E50S, CDR3 CowStalks-1xG4S ShK of plasmid 132-453
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggaaggagctgcatcgacaccatccccaagagccgatgcaccgccttccagtgcaagcacagcatgaagtacaggctgagcttctgcaggaagacctgcggcacctgcggaggtggtggatcttcttatacctacaattatgaatggcatgtggatgtctggggacagggcctgctggtgacagtctctagtgctagc

SEQ ID NO: 886 - DNA, 537 bp, Artificial Sequence
  synthesized: heavy chain VH4-34 Q5RQ6E, G31DY32K, E50S, CDR3 CowStalks-1xG4S ShK-16K of plasmid 132-52
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggaaggagctgcatcgacaccatccccaagagccgatgcaccgccttcaagtgcaagcacagcatgaagtacaggctgagcttctgcaggaagacctgcggcacctgcggaggtggtggatcttcttatacctacaattatgaatggcatgtggatgtctggggacagggcctgctggtgacagtctctagtgctagc

SEQ ID NO: 887 - DNA, 597 bp, Artificial Sequence
  synthesized: heavy chain VH4-34 Q5RQ6E, G31DY32K, E50S, CDR3 CowStalks-3xG4S ShK-16K of plasmid 132-56
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttcaagtgcaagcacagcatgaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 888 - DNA, 501 bp, Artificial Sequence
  synthesized: heavy chain VH4-34 Q5RQ6E, G31DY32K, E50S, CDR3 Shk-No Linker of plasmid 132-61
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcaggagctgcatcgacaccatccccaagagccgatgcaccgccttccagtgcaagcacagcatgaagtacaggctgagcttctgcaggaagacctgcggcacctgctcttatacctacaattatgaatggcatgtggatgtctggggacagggcctgctggtgacagtctctagtgctagc

SEQ ID NO: 889 - DNA, 507 bp, Artificial Sequence
  synthesized: heavy chain VH4-34 Q5RQ6E, G31DY32K, E50S, CDR3 G-ShK-G of plasmid 132-62
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggcaggagctgcatcgacaccatccccaagagccgatgcaccgccttccagtgcaagcacagcatgaagtacaggctgagcttctgcaggaagacctgcggcacctgcggatcttatacctacaattatgaatggcatgtggatgtctggggacagggcctgctggtgacagtctctagtgctagc

SEQ ID NO: 890 - DNA, 513 bp, Artificial Sequence
  synthesized: heavy chain VH4-34 MutE GG-ShK-GG of plasmid 132-63
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggcgggaggagctgcatcgacaccatccccaagagccgatgcaccgccttccagtgcaagcacagcatgaagtacaggctgagcttctgcaggaagacctgcggcacctgcggaggctcttatacctacaattatgaatggcatgtggatgtctggggacagggcctgctggtgacagtctctagtgctagc

SEQ ID NO: 891 - DNA, 525 bp, Artificial Sequence
  synthesized: heavy chain VH4-34 Q5RQ6E, G31DY32K, E50S, CDR3 GSGG-Shk-GGGG of plasmid 132-75
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggttctggaggaaggagctgcatcgacaccatccccaagagccgatgcaccgccttccagtgcaagcacagcatgaagtacaggctgagcttctgcaggaagacctgcggcacctgcggaggtggtggatcttatacctacaattatgaatggcatgtggatgtctggggacagggcctgctggtgacagtctctagtgctagc

SEQ ID NO: 892 - DNA, 525 bp, Artificial Sequence
  synthesized: heavy chain VH4-34 Q5RQ6E, G31DY32K, E50S, CDR3 GGGG-Shk-GGGG of plasmid 132-76
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggtaggagctgcatcgacaccatccccaagagccgatgcaccgccttccagtgcaagcacagcatgaagtacaggctgagcttctgcaggaagacctgcggcacctgcggaggtggtggatcttatacctacaattatgaatggcatgtggatgtctggggacagggcctgctggtgacagtctctagtgctagc

SEQ ID NO: 893 - DNA, 519 bp, Artificial Sequence
  synthesized: heavy chain VH4-34 Q5RQ6E, G31DY32K, E50S, CDR3 GGG-Shk-GGG of plasmid 132-77
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggaggaggtaggagctgcatcgacaccatccccaagagccgatgcaccgccttccagtgcaagcacagcatgaagtacaggctgagcttctgcaggaagacctgcggcacctgcggtggtggatcttatacctacaattatgaatggcatgtggatgtctggggacagggcctgctggtgacagtctctagtgctagc

SEQ ID NO: 894 - DNA, 597 bp, Artificial Sequence
  synthesized: heavy chain VH4-34 Q5RQ6E S62G MutE -CD1_G31DY32K_CD2_E50S_CD3_3XG4S_Shk of plasmid 132-76
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgggcctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcatgaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 895 - DNA, 567 bp, Artificial Sequence
  synthesized: heavy chain VH4-34 Q5RQ6E MutE_CD1_ G31DY32K_CD2_E50S_CDR3_2xG4S ShK of plasmid 134-12
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggaggcggtggaagtggtggcggaggtagcggaggaaggagctgcatcgacaccatccccaagagccgatgcaccgccttccagtgcaagcacagcatgaagtacaggctgagcttctgcaggaagacctgcggcacctgcggtggaggaggcagtggaggtggtggcagctcttatacctacaattatgaatggcatgtggatgtctggggacagggcctgctggtgacagtctctagtgctagc

SEQ ID NO: 896 - DNA, 597 bp, Artificial Sequence
  synthesized: heavy chain VH4-34 Q5RQ6E MutE_CD1_ G31DY32K_CD2_E50S_CDR3_3xG4S ShK (M21Q) of plasmid 134-13
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagccagaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 897 - DNA, 597 bp, Artificial Sequence
  synthesized: heavy chain VH4-34 Q5RQ6E MutE_CD1_ G31DY32K_CD2_E50S_CDR3_3xG4S ShK (M21L) of plasmid 134-14
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcctgaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 898 - DNA, 597 bp, Artificial Sequence
  synthesized: heavy chain VH4-34 Q5RQ6E MutE_CD1_ G31DY32K_CD2_E50S_CDR3_3xG4S ShK (M21F) of plasmid 134-15
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcttcaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 899 - DNA, 597 bp, Artificial Sequence
  synthesized: heavy chain VH4-34 Q5RQ6E MutE_CD1_ G31DY32K_CD2_E50S_CDR3_3xG4S ShK (M21I) of plasmid 134-16
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcatcaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 900 - DNA, 597 bp, Artificial Sequence
  synthesized: heavy chain VH4-34 Q5RQ6E MutE_CD1_ G31DY32K_CD2_E50S_CDR3_3xG4S ShK (M21A) of plasmid 134-17
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggcggtggaagtggtggcggaggtagcggaggaaggagctgcatcgacaccatccccaagagccgatgcaccgccttccagtgcaagcacagcgccaagtacaggctgagcttctgcaggaagacctgcggcacctgcggaggtggtggatctggtggaggaggcagtggaggtggtggcagctcttatacctacaattatgaatggcatgtggatgtctggggacagggcctgctggtgacagtctctagtgctagc

SEQ ID NO: 901 - DNA, 522 bp, Artificial Sequence
  synthesized: heavy chain VH4-34 Q5RQ6E, G31DY32K, E50S, CDR3 CowStalks-1xG4S ProTxII of plasmid 132-54
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggatactgccagaagtggatgtggacctgcgacagcgagaggaagtgctgcgagggcatggtgtgcaggctgtggtgcaagaagaagctgtggggaggtggtggatcttcttatacctacaattatgaatggcatgtggatgtctggggacagggcctgctggtgacagtctctagtgctagc

SEQ ID NO: 902 - DNA, 534 bp, Artificial Sequence
  synthesized: heavy chain VH4-34 Q5RQ6E, G31DY32K, E50S, CDR3 CowStalks-1xG4S GPTX1 of plasmid 132-55
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcggtggaggaggttctggaggagactgcctgggcttcatgaggaagtgcatccccgacaacgacaagtgctgcaggcccaacctggtgtgcagcaggacccacaagtggtgcaagtacgtgttcggaggtggtggatcttcttatacctacaattatgaatggcatgtggatgtctggggacagggcctgctggtgacagtctctagtgctagc

SEQ ID NO: 903 - protein, 168 aa, Artificial Sequence
  synthesized: heavy chain BLV1H12 HC GGS1:1 ProTxII of plasmid 131-34
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSYCQKWMWTCDSERKCCEGMVCRLWCKKKLWGGSSYTYNYEWHVDVWGQGLLVTVSSAS

SEQ ID NO: 904 - protein, 171 aa, Artificial Sequence
  synthesized:  heavy chain BLV1H12 HC GGS1:2 ProTxII of plasmid 131-35
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSYCQKWMWTCDSERKCCEGMVCRLWCKKKLWGGSGGSSYTYNYEWHVDVWGQGLLVTVSSAS

SEQ ID NO: 905 - protein, 171 aa, Artificial Sequence
  synthesized: heavy chain BLV1H12 HC GGS2:1 ProTxII of plasmid 131-36
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSYCQKWMWTCDSERKCCEGMVCRLWCKKKLWGGSSYTYNYEWHVDVWGQGLLVTVSSAS

SEQ ID NO: 906 - protein, 172 aa, Artificial Sequence
  synthesized: heavy chain BLV1H12 HC GGS1:1 GG-ProTxII-GG of plasmid 131-37
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGYCQKWMWTCDSERKCCEGMVCRLWCKKKLWGGGGSSYTYNYEWHVDVWGQGLLVTVSSAS

SEQ ID NO: 907 - protein, 175 aa, Artificial Sequence
  synthesized: heavy chain BLV1H12 HC GGS1:2 GG-ProTxII-GG of plasmid 131-38
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGYCQKWMWTCDSERKCCEGMVCRLWCKKKLWGGGGSGGSSYTYNYEWHVDVWGQGLLVTVSSAS

SEQ ID NO: 908 - protein, 175 aa, Artificial Sequence
  synthesized: heavy chain BLV1H12 HC GGS2:1 GG-ProTxII-GG of plasmid 131-39
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGYCQKWMWTCDSERKCCEGMVCRLWCKKKLWGGGGSSYTYNYEWHVDVWGQGLLVTVSSAS

SEQ ID NO: 909 - protein, 174 aa, Artificial Sequence
  synthesized: heavy chain BLV1H12 HC GGS2:2 ProTxII of plasmid 131-44
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSYCQKWMWTCDSERKCCEGMVCRLWCKKKLWGGSGGSSYTYNYEWHVDVWGQGLLVTVSSAS

SEQ ID NO: 910 - protein, 180 aa, Artificial Sequence
  synthesized: heavy chain BLV1H12 HC GGS2:4 ProTxII of plasmid 131-45
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSYCQKWMWTCDSERKCCEGMVCRLWCKKKLWGGSGGSGGSGGSSYTYNYEWHVDVWGQGLLVTVSSAS

SEQ ID NO: 911 - protein, 180 aa, Artificial Sequence
  synthesized: heavy chain BLV1H12 HC GGS4:2 ProTxII of plasmid 131-46
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGSGGSYCQKWMWTCDSERKCCEGMVCRLWCKKKLWGGSGGSSYTYNYEWHVDVWGQGLLVTVSSAS

SEQ ID NO: 912 - protein, 178 aa, Artificial Sequence
  synthesized: heavy chain BLV1H12 HC GGS2:2 GG-ProTxII-GG of plasmid 131-47
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGYCQKWMWTCDSERKCCEGMVCRLWCKKKLWGGGGSGGSSYTYNYEWHVDVWGQGLLVTVSSAS

SEQ ID NO: 913 - protein, 181 aa, Artificial Sequence
  synthesized: heavy chain BLV1H12 HC GGS 2:3 GG-ProTxII-GG of plasmid 131-48
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGYCQKWMWTCDSERKCCEGMVCRLWCKKKLWGGGGSGGSGGSSYTYNYEWHVDVWGQGLLVTVSSAS

SEQ ID NO: 914 - protein, 184 aa, Artificial Sequence
  synthesized: heavy chain BLV1H12 HC GGS 2:4 GG-ProTxII-GG of plasmid 131-49
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGYCQKWMWTCDSERKCCEGMVCRLWCKKKLWGGGGSGGSGGSGGSSYTYNYEWHVDVWGQGLLVTVSSAS

SEQ ID NO: 915 - protein, 181 aa, Artificial Sequence
  synthesized: heavy chain BLV1H12 HC GGS 3:2 GG-ProTxII-GG of plasmid 131-50
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGSGGYCQKWMWTCDSERKCCEGMVCRLWCKKKLWGGGGSGGSSYTYNYEWHVDVWGQGLLVTVSSAS

SEQ ID NO: 916 - protein, 184 aa, Artificial Sequence
  synthesized: heavy chain BLV1H12 HC GGS 3:3 GG-ProTxII-GG of plasmid 131-51
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGSGGYCQKWMWTCDSERKCCEGMVCRLWCKKKLWGGGGSGGSGGSSYTYNYEWHVDVWGQGLLVTVSSAS

SEQ ID NO: 917 - protein, 184 aa, Artificial Sequence
  synthesized: heavy chain BLV1H12 HC GGS 4:2 GG-ProTxII-GG of plasmid 131-52
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGSGGSGGSGGSGGYCQKWMWTCDSERKCCEGMVCRLWCKKKLWGGGGSGGSSYTYNYEWHVDVWGQGLLVTVSSAS

SEQ ID NO: 918 - protein, 194 aa, Artificial Sequence
  synthesized: heavy chain BLV1H12 GTLV 3xG4S ProTxII of plasmid 131-56
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGYCQKWMWTCDSERKCCEGMVCRLWCKKKLWGGGGSGGGGSGGGGSSYTYNYEWHVDVWGQGTLVTVSSAS

SEQ ID NO: 919 - protein, 199 aa, Artificial Sequence
  synthesized: heavy chain BLV1H12 GTLV 3xG4S ShK of plasmid 131-59
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGRSCIDTIPKSRCTAFQCKHSMKYRLSFCRKTCGTCGGGGSGGGGSGGGGSSYTYNYEWHVDVWGQGTLVTVSSAS

SEQ ID NO: 920 - protein, 202 aa, Artificial Sequence
  synthesized: heavy chain BLV1H12 GTLV 3xG4S OSK1 (K16,D20) of plasmid 131-60
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGGVIINVKCKISRQCLKPCKDAGMRFGKCMNGKCHCTPKGGGGSGGGGSGGGGSSYTYNYEWHVDVWGQGTLVTVSSAS

SEQ ID NO: 921 - protein, 202 aa, Artificial Sequence
  synthesized: heavy chain BLV1H12 GTLV 3xG4S OSK1 (P12,K16,D20) of plasmid 131-61
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGGVIINVKCKISPQCLKPCKDAGMRFGKCMNGKCHCTPKGGGGSGGGGSGGGGSSYTYNYEWHVDVWGQGTLVTVSSAS

SEQ ID NO: 922 - protein, 198 aa, Artificial Sequence
  synthesized: heavy chain BLV1H12 cowV HumanC 3xG4S GPTX of plasmid 131-62
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGDCLGFMRKCIPDNDKCCRPNLVCSRTHKWCKYVFGGGGSGGGGSGGGGSSYTYNYEWHVDVWGQGTLVTVSSAS

SEQ ID NO: 923 - protein, 162 aa, Artificial Sequence
  synthesized: heavy chain BLV1H12 GTLV 6xG4S  of plasmid 131-64
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGGGSGGGGSGGGGSSYTYNYEWHVDVWGQGTLVTVSSAS

SEQ ID NO: 924 - protein, 152 aa, Artificial Sequence
  synthesized: heavy chain BLV1H12 GTLV 1xG4S BsaIs (wStop) of plasmid 131-65
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGDLLWFRVSGGGGSSYTYNYEWHVDVWGQGTLVTVSSAS

SEQ ID NO: 925 - protein, 171 aa, Artificial Sequence
  synthesized: heavy chain BLV1H12 HC CowV, Human CH1-2-3(107) of plasmid 131-74
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSCPDGYRERSDCSNRPACGTSDCCRVSVFGNCLTTLPVSYSYTYNYEWHVDVWGQGLLVTVSSAS

SEQ ID NO: 926 - protein, 209 aa, Artificial Sequence
  synthesized: heavy chain BLV1H12 HC CowV, CDR3 IL-8,  Human CH1-2-3 (105) of plasmid 131-76
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSPRSAKELRCQCIKTYSKPFHPKFIKELRVIESGPHCANTEIIVKLSDGRELCLDPKENWVQRVVEKFLKRAENSGSGSYTYNYEWHVDVWGQGLLVTVSSAS

SEQ ID NO: 927 - protein, 218 aa, Artificial Sequence
  synthesized: heavy chain BLV1H12 CowV 1xGGGGS linker- IL-8 -HumanCH123 of plasmid 131-71
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGPRSAKELRCQCIKTYSKPFHPKFIKELRVIESGPHCANTEIIVKLSDGRELCLDPKENWVQRVVEKFLKRAENSGGGGSSYTYNYEWHVDVWGQGLLVTVSSAS

SEQ ID NO: 928 - protein, 238 aa, Artificial Sequence
  synthesized: heavy chain BLV1H12 CowV 3xGGGGS linker- IL-8 -HumanCH123 of plasmid 131-72
QVQLRESGPSLVKPSQTLSLTCTASGFSLSDKAVGWVRQAPGKALEWLGSIDTGGNTGYNPGLKSRLSITKDNSKSQVSLSVSSVTTEDSATYYCTSVHQETKKYQSGGGGSGGGGSGGGGSGGPRSAKELRCQCIKTYSKPFHPKFIKELRVIESGPHCANTEIIVKLSDGRELCLDPKENWVQRVVEKFLKRAENSGGGGSGGGGSGGGGSSYTYNYEWHVDVWGQGLLVTVSSAS

SEQ ID NO: 929 - protein, 238 aa, Artificial Sequence
  synthesized: heavy chain VH4-34 Q5RQ6E, G31DY32K, E50S, 3xG4S, IL-8 of plasmid 132-37
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGPRSAKELRCQCIKTYSKPFHPKFIKELRVIESGPHCANTEIIVKLSDGRELCLDPKENWVQRVVEKFLKRAENSGGGGSGGGGSGGGGSSYTYNYEWHVDVWGQGLLVTVSSAS

SEQ ID NO: 930 - protein, 199 aa, Artificial Sequence
  synthesized: heavy chain VH4-34 Q5RQ6E, G31DY32K, E50S, 3xG4S, ShK of plasmid 132-35
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGRSCIDTIPKSRCTAFQCKHSMKYRLSFCRKTCGTCGGGGSGGGGSGGGGSSYTYNYEWHVDVWGQGLLVTVSSAS

SEQ ID NO: 931 - protein, 185 aa, Artificial Sequence
  synthesized: heavy chain VH4-34 Q5RQ6E, G31DY32K, E50S, 3:3GGS, MOKA of plasmid 132-36
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGSGGSGGSGINVKCSLPQQCIKPCKDAGMRFGKCMNKKCRCYSGGSGGSGGSSYTYNYEWHVDVWGQGLLVTVSSAS

SEQ ID NO: 932 - protein, 199 aa, Artificial Sequence
  synthesized: heavy chain VH4-34 Q5RQ6E, CDR1 Cow, 3xG4S, ShK of plasmid 132-38
QVQLREWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQSGGGGSGGGGSGGGGSGGRSCIDTIPKSRCTAFQCKHSMKYRLSFCRKTCGTCGGGGSGGGGSGGGGSSYTYNYEWHVDVWGQGLLVTVSSAS

SEQ ID NO: 933 - protein, 238 aa, Artificial Sequence
  synthesized: heavy chain VH4-34 Q5RQ6E, CDR1 Cow,3xG4S, IL-8 of plasmid 132-40
QVQLREWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQSGGGGSGGGGSGGGGSGGPRSAKELRCQCIKTYSKPFHPKFIKELRVIESGPHCANTEIIVKLSDGRELCLDPKENWVQRVVEKFLKRAENSGGGGSGGGGSGGGGSSYTYNYEWHVDVWGQGLLVTVSSAS

SEQ ID NO: 934 - protein, 185 aa, Artificial Sequence
  synthesized: heavy chain VH4-34 Q5RQ6E, CDR1 Cow,3:3GGS, MOKA of plasmid 132-39
QVQLREWGAGLLKPSETLSLTCTASGFSLSDKAVGWIRQPPGKGLEWIGEINHSGSTNYNPSLKSRVTISVDTSKNQFSLKLSSVTAADTAVYYCTSVHQETKKYQSGGSGGSGGSGINVKCSLPQQCIKPCKDAGMRFGKCMNKKCRCYSGGSGGSGGSSYTYNYEWHVDVWGQGLLVTVSSAS

SEQ ID NO: 935 - protein, 194 aa, Artificial Sequence
  synthesized: heavy chain VH4-34 Q5RQ6E, G31DY32K, E50S, 3xG4S, ProTxII of plasmid 132-31
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGYCQKWMWTCDSERKCCEGMVCRLWCKKKLWGGGGSGGGGSGGGGSSYTYNYEWHVDVWGQGLLVTVSSAS

SEQ ID NO: 936 - protein, 198 aa, Artificial Sequence
  synthesized: heavy chain VH4-34 Q5RQ6E, G31DY32K, E50S, 3xG4S, GPTX1 of plasmid 132-34
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGDCLGFMRKCIPDNDKCCRPNLVCSRTHKWCKYVFGGGGSGGGGSGGGGSSYTYNYEWHVDVWGQGLLVTVSSAS

SEQ ID NO: 937 - protein, 141 aa, Artificial Sequence
  synthesized: heavy chain VH4-34 Q5RQ6E, G31DY32K, E50S, CDR3 CowStalks-3xGGS of plasmid 132-49
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGSGGSGGSSYTYNYEWHVDVWGQGLLVTVSSAS

SEQ ID NO: 938 - protein, 179 aa, Artificial Sequence
  synthesized: heavy chain VH4-34 Q5RQ6E, G31DY32K, E50S, CDR3 CowStalks-1xG4S ShK of plasmid 132-453
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGRSCIDTIPKSRCTAFQCKHSMKYRLSFCRKTCGTCGGGGSSYTYNYEWHVDVWGQGLLVTVSSAS

SEQ ID NO: 939 - protein, 179 aa, Artificial Sequence
  synthesized: heavy chain VH4-34 Q5RQ6E, G31DY32K, E50S, CDR3 CowStalks-1xG4S ShK-16K of plasmid 132-52
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGRSCIDTIPKSRCTAFKCKHSMKYRLSFCRKTCGTCGGGGSSYTYNYEWHVDVWGQGLLVTVSSAS

SEQ ID NO: 940 - protein, 199 aa, Artificial Sequence
  synthesized: heavy chain VH4-34 Q5RQ6E, G31DY32K, E50S, CDR3 CowStalks-3xG4S ShK-16K of plasmid 132-56
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGRSCIDTIPKSRCTAFKCKHSMKYRLSFCRKTCGTCGGGGSGGGGSGGGGSSYTYNYEWHVDVWGQGLLVTVSSAS

SEQ ID NO: 941 - protein, 167 aa, Artificial Sequence
  synthesized: heavy chain VH4-34 Q5RQ6E, G31DY32K, E50S, CDR3 Shk-No Linker of plasmid 132-61
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSRSCIDTIPKSRCTAFQCKHSMKYRLSFCRKTCGTCSYTYNYEWHVDVWGQGLLVTVSSAS

SEQ ID NO: 942 - protein, 169 aa, Artificial Sequence
  synthesized: heavy chain VH4-34 Q5RQ6E, G31DY32K, E50S, CDR3 G-ShK-G of plasmid 132-62
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGRSCIDTIPKSRCTAFQCKHSMKYRLSFCRKTCGTCGSYTYNYEWHVDVWGQGLLVTVSSAS

SEQ ID NO: 943 - protein, 171 aa, Artificial Sequence
  synthesized: heavy chain VH4-34 MutE GG-ShK-GG of plasmid 132-63
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGRSCIDTIPKSRCTAFQCKHSMKYRLSFCRKTCGTCGGSYTYNYEWHVDVWGQGLLVTVSSAS

SEQ ID NO: 944 - protein, 175 aa, Artificial Sequence
  synthesized: heavy chain VH4-34 Q5RQ6E, G31DY32K, E50S, CDR3 GSGG-Shk-GGGG of plasmid 132-75
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGSGGRSCIDTIPKSRCTAFQCKHSMKYRLSFCRKTCGTCGGGGSYTYNYEWHVDVWGQGLLVTVSSAS

SEQ ID NO: 945 - protein, 175 aa, Artificial Sequence
  synthesized: heavy chain VH4-34 Q5RQ6E, G31DY32K, E50S, CDR3 GGGG-Shk-GGGG of plasmid 132-76
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGRSCIDTIPKSRCTAFQCKHSMKYRLSFCRKTCGTCGGGGSYTYNYEWHVDVWGQGLLVTVSSAS

SEQ ID NO: 946 - protein, 173 aa, Artificial Sequence
  synthesized: heavy chain VH4-34 Q5RQ6E, G31DY32K, E50S, CDR3 GGG-Shk-GGG of plasmid 132-77
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGRSCIDTIPKSRCTAFQCKHSMKYRLSFCRKTCGTCGGGSYTYNYEWHVDVWGQGLLVTVSSAS

SEQ ID NO: 947 - protein, 199 aa, Artificial Sequence
  synthesized: heavy chain VH4-34 Q5RQ6E S62G MutE -CD1_G31DY32K_CD2_E50S_CD3_3XG4S_Shk of plasmid 132-76
QVQLREWGAGLLKPSETLSLTCAVYGGSFSDKYWSWIRQPPGKGLEWIGSINHSGSTNYNPGLKSRVTISVDTSKNQFSLKLSSVTAADTAVYYCTSVHQETKKYQSGGGGSGGGGSGGGGSGGRSCIDTIPKSRCTAFQCKHSMKYRLSFCRKTCGTCGGGGSGGGGSGGGGSSYTYNYEWHVDVWGQGLLVTVSSAS

SEQ ID NO: 948 - protein, 189 aa, Artificial Sequence
  synthesized: heavy chain VH4-34 Q5RQ6E MutE_CD1_ G31DY32K_CD2_E50S_CDR3_2xG4S ShK of plasmid 134-12
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGRSCIDTIPKSRCTAFQCKHSMKYRLSFCRKTCGTCGGGGSGGGGSSYTYNYEWHVDVWGQGLLVTVSSAS

SEQ ID NO: 949 - protein, 199 aa, Artificial Sequence
  synthesized: heavy chain VH4-34 Q5RQ6E MutE_CD1_ G31DY32K_CD2_E50S_CDR3_3xG4S ShK (M21Q) of plasmid 134-13
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGRSCIDTIPKSRCTAFQCKHSQKYRLSFCRKTCGTCGGGGSGGGGSGGGGSSYTYNYEWHVDVWGQGLLVTVSSAS

SEQ ID NO: 950 - protein, 199 aa, Artificial Sequence
  synthesized: heavy chain VH4-34 Q5RQ6E MutE_CD1_ G31DY32K_CD2_E50S_CDR3_3xG4S ShK (M21L) of plasmid 134-14
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGRSCIDTIPKSRCTAFQCKHSLKYRLSFCRKTCGTCGGGGSGGGGSGGGGSSYTYNYEWHVDVWGQGLLVTVSSAS

SEQ ID NO: 951 - protein, 199 aa, Artificial Sequence
  synthesized: heavy chain VH4-34 Q5RQ6E MutE_CD1_ G31DY32K_CD2_E50S_CDR3_3xG4S ShK (M21F) of plasmid 134-15
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGRSCIDTIPKSRCTAFQCKHSFKYRLSFCRKTCGTCGGGGSGGGGSGGGGSSYTYNYEWHVDVWGQGLLVTVSSAS

SEQ ID NO: 952 - protein, 199 aa, Artificial Sequence
  synthesized: heavy chain VH4-34 Q5RQ6E MutE_CD1_ G31DY32K_CD2_E50S_CDR3_3xG4S ShK (M21I) of plasmid 134-16
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGRSCIDTIPKSRCTAFQCKHSIKYRLSFCRKTCGTCGGGGSGGGGSGGGGSSYTYNYEWHVDVWGQGLLVTVSSAS

SEQ ID NO: 953 - protein, 199 aa, Artificial Sequence
  synthesized: heavy chain VH4-34 Q5RQ6E MutE_CD1_ G31DY32K_CD2_E50S_CDR3_3xG4S ShK (M21A) of plasmid 134-17
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGGGSGGGGSGGRSCIDTIPKSRCTAFQCKHSAKYRLSFCRKTCGTCGGGGSGGGGSGGGGSSYTYNYEWHVDVWGQGLLVTVSSAS

SEQ ID NO: 954 - protein, 174 aa, Artificial Sequence
  synthesized: heavy chain VH4-34 Q5RQ6E, G31DY32K, E50S, CDR3 CowStalks-1xG4S ProTxII of plasmid 132-54
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGYCQKWMWTCDSERKCCEGMVCRLWCKKKLWGGGGSSYTYNYEWHVDVWGQGLLVTVSSAS

SEQ ID NO: 955 - protein, 178 aa, Artificial Sequence
  synthesized: heavy chain VH4-34 Q5RQ6E, G31DY32K, E50S, CDR3 CowStalks-1xG4S GPTX1 of plasmid 132-55
QVQLREWGAGLLKPSETLSLTCAVYGGSFSDKYWSWIRQPPGKGLEWIGSINHSGSTNYNPSLKSRVTISVDTSKNQFSLKLSSVTAADTAVYYCTSVHQETKKYQSGGGGSGGDCLGFMRKCIPDNDKCCRPNLVCSRTHKWCKYVFGGGGSSYTYNYEWHVDVWGQGLLVTVSSAS

SEQ ID NO: 956 - protein, 110 aa, Artificial Sequence; identical to SEQ ID NO: 35
  Synthesized: VH region of Lambda LC

SEQ ID NO: 957 - DNA, 420 bp, Artificial Sequence
  Synthesized: VH4-34 MutE
caggtgcagctaagagagtggggcgcaggactgttgaagccttcggagacgctgtccctcacctgcgctgtctatggtgggtccttcagtgacaagtactggagctggattcgccagcccccagggaaggggctggagtggattgggagcatcaatcatagtggaagcaccaactacaacccgtccctcaagagtcgagtcaccatatcagtagacacgtccaagaaccagttctccctgaagctgagctctgtgaccgccgcggacacggctgtgtattactgtacctctgtgcaccaggaaactaagaaataccagagcgagacctactatggttcgggtctctcttatacctacaattatgaatggcatgtggatgtctggggacagggcctgctggtgacagtctctagtgctagc

SEQ ID NO: 958 - DNA, 519 bp, Artificial Sequence
  Synthesized: BLV1H12-HumanJ-CDR3-G4Sx3-BsaI
caggtccagctgagagagagcggcccttcactggtcaagccatcccagacactgagcctgacatgcacagcaagcgggttttcactgagcgacaaggcagtgggatgggtccgacaggcaccaggaaaagccctggaatggctgggcagcatcgataccggcgggaacacagggtacaatcccggactgaagagcagactgtccattaccaaggacaactctaaaagtcaggtgtcactgagcgtgagctccgtcaccacagaggatagtgcaacttactattgcacctctgtgcaccaggaaactaagaaataccagagcggtggaggaggttctggaggcggtggaagtggtggcggaggtagcggaggatgagacctactatggttcagggtctctggaggtggtggatctggtggaggaggcagtggaggtggtggcagctcttatacctacaattatgaatggcatgtggatgtctggggccaaggaaccctggtcaccgtctcctcagctagc

SEQ ID NO: 959 - protein, 110 aa, Artificial Sequence
  Synthesized: VL1-51 S2A, T5N, P8S, A12G ,A13S, P14L, K46R, L47T, D51G, N52D, N53T, with CDR3 in BLV1H12 Light Chain and J region after CDR3 in BLV1H12 Light Chain
QAVLNQPSSVSGSLGQKVTISCSGSSSNIGNNYVSWYQQLPGTAPRTLIYGDTKRPSGIPDRFSGSKSGTSATLGITGLQTGDEADYYCASAEDSSSNAVFGSGTTLTVL

The invention claimed is:

1. A humanized antibody or binding fragment thereof comprising:
   (1) a heavy chain variable region comprising a sequence of the formula V1-X-V2, wherein:
      (a) V1 comprises an amino acid sequence selected from the group consisting of:
         (i) SEQ ID NO: 734 or SEQ ID NO: 735,
         (ii) SEQ ID NO: 736 or SEQ ID NO: 737,
         (iii) SEQ ID NO: 738 or SEQ ID NO: 739,
         (vi) SEQ ID NO: 740 or SEQ ID NO: 741,
         (v) SEQ ID NO: 742 or SEQ ID NO: 743,
         (vi) SEQ ID NO: 744 or SEQ ID NO: 745,
         (vii) SEQ ID NO: 746 or SEQ ID NO: 747, and
         (viii) SEQ ID NO: 748 or SEQ ID NO: 749; and
      (b) X comprises an ultralong CDR3, wherein the ultralong CDR3 is 35 amino acids or longer in length and comprises an amino acid sequence TSVHQETKKYQS (SEQ ID NO: 498) and an amino acid sequence SYTYNYEWHVDV (SEQ ID NO: 499) and a non-antibody sequence, wherein the non-antibody sequence is a cytokine sequence, a lymphokine sequence, a chemokine sequence, a growth factor sequence, a hormone sequence or a toxin sequence; and
      (c) V2 comprises an amino acid sequence selected from the group consisting of WGHGTAVTVSS (SEQ ID NO: 570), WGKGTTVTVSS (SEQ ID NO: 571), WGKGTTVTVSS (SEQ ID NO: 572), WGRGTLVTVSS (SEQ ID NO: 573), WGKGTTVTVSS (SEQ ID NO: 574), and WGQGLLVTVSS (SEQ ID NO: 500); and
   (2) a light chain variable region comprising a variable region of the VL1-51 germline sequence set forth in SEQ ID NO:805, or a modified sequence comprising the sequence of SEQ ID NO:805 except comprising I29V and N32G substitutions, or S2A, T5N, P8S, A12G, A13S, and P14L substitutions.

2. The humanized antibody or binding fragment thereof of claim 1, wherein the ultralong CDR3 is 40 amino acids in length or longer, 45 amino acids in length or longer, 50 amino acids in length or longer, 55 amino acids in length or longer, or 60 amino acids in length or longer.

3. The humanized antibody or binding fragment thereof of claim 1, wherein the ultralong CDR3 comprises 3 or more cysteine residues, 4 or more cysteine residues, 5 or more cysteine residues, 6 or more cysteine residues, 7 or more cysteine residues, 8 or more cysteine residues, 9 or more cysteine residues, 10 or more cysteine residues, 11 or more cysteine residues, or 12 or more cysteine residues.

4. The humanized antibody or binding fragment thereof of claim 1, wherein the non-antibody sequence is an IL-8 sequence, an IL-21 sequence, an SDF-1 (alpha) sequence, a somatostatin sequence, a chlorotoxin sequence, a Pro-TxII sequence, a ziconotide sequence, an ADWX-1 sequence, an HsTx1 sequence, an OSK1 sequence, a Pi2 sequence, a Hongotoxin (HgTX) sequence, a Margatoxin sequence, an Agitoxin-2 sequence, a Pi3 sequence, a Kaliotoxin sequence, an Anuroctoxin sequence, a Charybdotoxin sequence, a Tityustoxin-K-alpha sequence, a Maurotoxin sequence, a Ceratotoxin 1 (CcoTx1) sequence, a CcoTx2 sequence, a CcoTx3 sequence, a Phrixotoxin 3 (PaurTx3) sequence, a Hanatoxin 1 sequence, a Phrixotoxin 1 sequence, a Huwentoxin-IV sequence, an α-conotoxin ImI sequence, an α-conotoxin EpI sequence, an α-conotoxin PnIA sequence, an αconotoxin PnIB sequence, an α-conotoxin MII sequence, an α-conotoxin AuIA sequence, an α-conotoxin AuIB sequence, an α-conotoxin AuIC sequence, a conotoxin κ-PVIIA sequence, a charybdotoxin sequence, a neurotoxin B-IV sequence, a crotamine sequence, a ω-GVIA (conotoxin) sequence, a κ-hefutoxin 1 sequence, a Css4 sequence, a Bj-xtrIT sequence, a BcIV sequence, a Hm-1 sequence, a Hm-2 sequence, a GsAF-I (β-theraphotoxin-Gr1b) sequence, a Protoxin I (ProTx-I sequence, a β-theraphotoxin-Tp1a) sequence, a Protoxin (ProTx II) sequence, a Huwentoxin I sequence, a μ-Conotoxin PIIIA sequence, a Jingzhaotoxin-III (β-TRTX-Cj1α) sequence, a GsAF-II (Kappa-theraphotoxin-Gr2c) sequence, a ShK (Stichodactyla toxin) sequence, a HsTx1 sequence, a Guangxitoxin 1E (GxTx-1E) sequence, a Maurotoxin sequence, a Charybdotoxin (ChTX) sequence, an Iberiotoxin (IbTx) sequence, a Leiurotoxin 1 (scyllatoxin) sequence, a Tamapin sequence, a Kaliotoxin-1 (KTX) sequence, a Purotoxin 1 (PT-1) sequence, a GpTx-1 sequence, a MOKA Toxin sequence, or a HmK sequence.

5. A polynucleotide(s) encoding the humanized antibody or binding fragment thereof of claim 1.

6. A vector comprising the polynucleotide of claim 5.

7. A host cell comprising the vector of claim 6.

8. A nucleic acid library comprising a plurality of polynucleotides comprising sequences coding for humanized antibodies or binding fragments thereof, wherein each of the antibodies or binding fragments thereof comprises:
   (1) a heavy chain variable region comprising a sequence of the formula V1-X-V2, wherein:
      (a) V1 comprises an amino acid sequence selected from the group consisting of:
         (i) SEQ ID NO: 734 or SEQ ID NO: 735,
         (ii) SEQ ID NO: 736 or SEQ ID NO: 737,
         (iii) SEQ ID NO: 738 or SEQ ID NO: 739,
         (vi) SEQ ID NO: 740 or SEQ ID NO: 741,
         (v) SEQ ID NO: 742 or SEQ ID NO: 743,
         (vi) SEQ ID NO: 744 or SEQ ID NO: 745,
         (vii) SEQ ID NO: 746 or SEQ ID NO: 747, and
         (viii) SEQ ID NO: 748 or SEQ ID NO: 749; and (b) X comprises an ultralong CDR3, wherein the ultralong CDR3 is 35 amino acids or longer in length and comprises an amino acid sequence TSVHQETKKYQS (SEQ ID NO: 498) and an amino acid sequence SYTYNYEWHVDV (SEQ ID NO: 499) and a non-antibody sequence, wherein the non-antibody sequence is a cytokine sequence, a lymphokine sequence, a chemokine sequence, a growth factor sequence, a hormone sequence or a toxin sequence; and (c) V2 comprises an amino acid sequence selected from the group consisting of WGHGTAVTVSS (SEQ ID NO: 570), WGKGTTVTVSS (SEQ ID NO: 571), WGKGTTVTVSS (SEQ ID NO: 572), WGRGTLVTVSS (SEQ ID NO: 573), WGKGTTVTVSS (SEQ ID NO: 574), and WGQGLLVTVSS (SEQ ID NO: 500) and (2) a light chain variable region comprising a variable region of the VL1-51 germline sequence set forth in SEQ ID NO:805, or a modified sequence comprising the sequence of SEQ ID NO:805 except comprising I29V and N32G substitutions, or S2A, T5N, P8S, A12G, A13S, and P14L substitutions.

9. A library of humanized antibodies or binding fragments thereof, wherein each of the antibodies or binding fragments thereof comprises:

(1) a heavy chain variable region comprising a sequence of the formula V1-X-V2, wherein:

(a) V1 comprises an amino acid sequence selected from the group consisting of:
(i) SEQ ID NO: 734 or SEQ ID NO: 735,
(ii) SEQ ID NO: 736 or SEQ ID NO: 737,
(iii) SEQ ID NO: 738 or SEQ ID NO: 739,
(vi) SEQ ID NO: 740 or SEQ ID NO: 741,
(v) SEQ ID NO: 742 or SEQ ID NO: 743,
(vi) SEQ ID NO: 744 or SEQ ID NO: 745,
(vii) SEQ ID NO: 746 or SEQ ID NO: 747, and
(viii) SEQ ID NO: 748 or SEQ ID NO:749; and (b) X comprises an ultralong CDR3, wherein the ultralong CDR3 is 35 amino acids or longer in length and comprises an amino acid sequence TSVHQETKKYQS (SEQ ID NO: 498) and an amino acid sequence SYTYNYEWHVDV (SEQ ID NO: 499) and a non-antibody sequence, wherein the non-antibody sequence is a cytokine sequence, a lymphokine sequence, a chemokine sequence, a growth factor sequence, a hormone sequence or a toxin sequence; and (c) V2 comprises an amino acid sequence selected from the group consisting of WGHGTAVTVSS (SEQ ID NO: 570), WGKGTTVTVSS (SEQ ID NO: 571), WGKGTTVTVSS (SEQ ID NO: 572), WGRGTLVTVSS (SEQ ID NO: 573), WGKGTTVTVSS (SEQ ID NO: 574), and WGQGLLVTVSS (SEQ ID NO: 500); and (2) a light chain variable region comprising a variable region of the VL1-51 germline sequence set forth in SEQ ID NO:805, or a modified sequence comprising the sequence of SEQ ID NO:805 except comprising I29V and N32G substitutions, or S2A, T5N, P8S, A12G, A13S, and P14L substitutions.

10. A method of generating a library of humanized antibodies that comprises an ultralong CDR3, the method comprising:

a.) combining nucleic acid sequences to produce a nucleic acid library comprising a plurality of polynucleotides comprising sequences coding for humanized antibodies or binding fragments thereof, wherein each of the polynucleotides comprises:

(1) a nucleic acid sequence encoding a heavy chain variable region comprising a sequence of the formula V1-X-V2, wherein:

(a) V1 comprises an amino acid sequence selected from the group consisting of:
(i) SEQ ID NO: 734 or SEQ ID NO: 735,
(ii) SEQ ID NO: 736 or SEQ ID NO: 737,
(iii) SEQ ID NO: 738 or SEQ ID NO: 739,
(vi) SEQ ID NO: 740 or SEQ ID NO: 741,
(v) SEQ ID NO: 742 or SEQ ID NO: 743,
(vi) SEQ ID NO: 744 or SEQ ID NO: 745,
(vii) SEQ ID NO: 746 or SEQ ID NO: 747, and
(viii) SEQ ID NO: 748 or SEQ ID NO:749; and (b) X comprises an ultralong CDR3, wherein the ultralong CDR3 is 35 amino acids or longer in length and comprises an amino acid sequence TSVHQETKKYQS (SEQ ID NO: 498) and an amino acid sequence SYTYNYEWHVDV (SEQ ID NO: 499) and a non-antibody sequence, wherein the non-antibody sequence is a cytokine sequence, a lymphokine sequence, a chemokine sequence, a growth factor sequence, a hormone sequence or a toxin sequence; and (c) V2 comprises an amino acid sequence selected from the group consisting of WGHGTAVTVSS (SEQ ID NO: 570), WGKGTTVTVSS (SEQ ID NO: 571), WGKGTTVTVSS (SEQ ID NO: 572), WGRGTLVTVSS (SEQ ID NO: 573), WGKGTTVTVSS (SEQ ID NO: 574), and WGQGLLVTVSS (SEQ ID NO: 500); and b.) expressing the polynucleotides encoding for humanized antibodies that comprises the heavy chain variable region comprising the ultralong CDR3 with a light chain variable region, said light chain variable region comprising a variable region of the VL1-51 germline sequence set forth in SEQ ID NO:805, or a modified sequence comprising the sequence of SEQ ID NO:805 except comprising I29V and N32G substitutions, S2A, T5N, P8S, A12G, A13S, and P14L substitutions, in a host cell.

11. The humanized antibody or binding fragment thereof of claim 1, wherein the ultralong CDR3 further comprises an additional sequence that is a linker.

12. The humanized antibody or binding fragment thereof of claim 11, wherein the linker is linked to a C-terminus, a N-terminus, or both C-terminus and N-terminus of the non-antibody sequence.

13. The humanized antibody or binding fragment thereof of claim 1, wherein the modified sequence comprising the sequence of SEQ ID NO:805 comprises I29V and N32G substitutions.

14. The humanized antibody or binding fragment thereof of claim 1, wherein the modified sequence comprising the sequence of SEQ ID NO:805 comprises S2A, T5N, P8S, A12G, A13S, and P14L substitutions.

15. The humanized antibody or binding fragment thereof of claim 1, wherein the light chain variable region comprises a sequence selected from the group of: (i) SEQ ID NO: 750, (ii) SEQ ID NO: 751, (iii) SEQ ID NO: 752, and (iv) SEQ ID NO: 753.

16. The humanized antibody or binding fragment thereof of claim 1, wherein the non-antibody sequence is the IL-8 sequence set forth in (SEQ ID NO: 475, the Protoxin (ProTx II) sequence set forth in SEQ ID NO: 640, the ShK (Stichodactyla toxin) sequence set forth in SEQ ID NO: 646, the GpTx-1 sequence set forth in SEQ ID NO: 655, or the MOKA Toxin sequence set forth in SEQ ID NO:727.

17. The humanized antibody or binding fragment thereof of claim 4, wherein the non-antibody sequence is the ShK (K16, Y26, K29) sequence set forth in SEQ ID NO: 731, the ShK (K16) sequence set forth in SEQ ID NO: 732, the ShK-A (K16) sequence set forth in SEQ ID NO: 733, the ShK (K16, E30) sequence set forth in SEQ ID NO: 645, the ShK (Q21) sequence set forth in SEQ ID NO: 831, the ShK (L21) sequence set forth in SEQ ID NO: 832, the ShK (F21) sequence set forth in SEQ ID NO: 833, the ShK (I21) sequence set forth in SEQ ID NO: 834, or the ShK (A21) sequence set forth in SEQ ID NO: 835.

18. The humanized antibody or binding fragment thereof of claim 1, wherein the heavy chain variable region comprises an amino acid sequence selected from the group consisting of SEQ ID NOs: 784-791, 794, 798, 800, and 925-955.

19. The humanized antibody or binding fragment thereof of claim 1, wherein the light chain comprises a sequence of amino acids set forth in SEQ ID NO: 780, SEQ ID NO: 781, SEQ ID NO:783, SEQ ID NO: 792, SEQ ID NO: 801 or SEQ ID NO: 804.

20. The humanized antibody or binding fragment thereof of claim 1, further comprising a constant heavy chain 1 (CH1) region and a constant light chain (CL) region.

21. The nucleic acid library of claim 8, wherein:
at least two members of the library differ in the length of the ultralong CDR3 sequence;
at least two members of the library differ in the human framework of the humanized antibody comprising the ultralong CDR3; and/or
at least two members of the library differ in the non-antibody protein sequence that comprises a portion of the ultralong CDR3.

22. The library of humanized antibodies or binding fragments thereof of claim 9, wherein:
at least two members of the library differ in the length of the ultralong CDR3 sequence;
at least two members of the library differ in the human framework of the humanized antibody comprising the ultralong CDR3; and/or
at least two members of the library differ in the non-antibody protein sequence that comprises a portion of the ultralong CDR3.

23. The method of generating a library of humanized antibodies of claim 10, wherein:
at least two members of the library differ in the length of the ultralong CDR3 sequence;
at least two members of the library differ in the human framework of the humanized antibody comprising the ultralong CDR3; and/or
at least two members of the library differ in the non-antibody protein sequence that comprises a portion of the ultralong CDR3.

24. The humanized antibody or binding fragment thereof of claim 4, wherein the non-antibody sequence is an IL-8 sequence, a Protoxin (ProTx II) sequence, a ShK (Stichodactyla toxin) sequence, or a GpTx-1 sequence, or a MOKA Toxin sequence.

25. The humanized antibody or binding fragment thereof of claim 24, wherein the non-antibody sequence is a ShK sequence.

26. The humanized antibody or binding fragment thereof of claim 25, wherein the ShK sequence comprises the amino acid sequence set forth in SEQ ID NO:646.

27. The humanized antibody or binding fragment thereof of claim 26, wherein V1 comprises an amino acid sequence set forth in SEQ ID NO:741.

28. The humanized antibody or binding fragment thereof of claim 4, wherein the non-antibody sequence is set forth in any one of SEQ ID NOS: 475-481, 599-655, 666-698, 727-733, and 808-810.

29. The humanized antibody or binding fragment thereof of claim 4, wherein the non-antibody sequence is the OSK1 (P12, K16, D20) sequence set forth in SEQ ID NO:728 or the OSK1 (K16, D20) sequence set forth in SEQ ID NO:729.

* * * * *